United States Patent 12,097,253 (RSV RNA MOLECULES AND COMPOSITIONS FOR VACCINATION) - sequence listing, part 15

SEQ ID NO: 21106 - RNA, 937 nt, synthetic construct
  misc_feature 1..937: note = mRNA product Design d-4 comprising derived and/or modified sequence from HRSV(Memphis-37)__AIY60641.1__M2-1 (opt2)
  source 1..937: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21107 - RNA, 937 nt, synthetic construct
  misc_feature 1..937: note = mRNA product Design d-4 comprising derived and/or modified sequence from HRSV(Memphis-37)__AIY60641.1__M2-1 (opt3)
  source 1..937: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21108 - RNA, 937 nt, synthetic construct
  misc_feature 1..937: note = mRNA product Design d-4 comprising derived and/or modified sequence from HRSV(Memphis-37)__AIY60641.1__M2-1 (opt4)
  source 1..937: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21109 - RNA, 937 nt, synthetic construct
  misc_feature 1..937: note = mRNA product Design d-4 comprising derived and/or modified sequence from HRSV(Memphis-37)__AIY60641.1__M2-1 (opt5)
  source 1..937: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21110 - RNA, 937 nt, synthetic construct
  misc_feature 1..937: note = mRNA product Design d-4 comprising derived and/or modified sequence from HRSV(Memphis-37)__AIY60641.1__M2-1 (opt6)
  source 1..937: mol_type = other RNA
gggagagtcccgcagtcggcgtccagcggctctgcttgttcgtgtgtgtgtcgttgcaggccttattcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21111 - RNA, 937 nt, synthetic construct
  misc_feature 1..937: note = mRNA product Design d-4 comprising derived and/or modified sequence from HRSV(Memphis-37)__AIY60641.1__M2-1 (opt11)
  source 1..937: mol_type = other RNA
gggagagtcccgcagtcggcgtccagcggctctgcttgttcgtgtgtgtgtcgttgcaggccttattcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21112 - RNA, 1034 nt, synthetic construct
  misc_feature 1..1034: note = mRNA product Design d-5 comprising derived and/or modified sequence from HRSV(Memphis-37)__AIY60641.1__M2-1 (wt)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21113 - RNA, 1034 nt, synthetic construct
  misc_feature 1..1034: note = mRNA product Design d-5 comprising derived and/or modified sequence from HRSV(Memphis-37)__AIY60641.1__M2-1 (opt1)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21114 - RNA, 1034 nt, synthetic construct
  misc_feature 1..1034: note = mRNA product Design d-5 comprising derived and/or modified sequence from HRSV(Memphis-37)__AIY60641.1__M2-1 (opt2)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21115 - RNA, 1034 nt, synthetic construct
  misc_feature 1..1034: note = mRNA product Design d-5 comprising derived and/or modified sequence from HRSV(Memphis-37)__AIY60641.1__M2-1 (opt3)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21116 - RNA, 1034 nt, synthetic construct
  misc_feature 1..1034: note = mRNA product Design d-5 comprising derived and/or modified sequence from HRSV(Memphis-37)__AIY60641.1__M2-1 (opt4)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21117 - RNA, 1034 nt, synthetic construct
  misc_feature 1..1034: note = mRNA product Design d-5 comprising derived and/or modified sequence from HRSV(Memphis-37)__AIY60641.1__M2-1 (opt5)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21118 - RNA, 1034 nt, synthetic construct
  misc_feature 1..1034: note = mRNA product Design d-5 comprising derived and/or modified sequence from HRSV(Memphis-37)__AIY60641.1__M2-1 (opt6)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21119 - RNA, 1034 nt, synthetic construct
  misc_feature 1..1034: note = mRNA product Design d-5 comprising derived and/or modified sequence from HRSV(Memphis-37)__AIY60641.1__M2-1 (opt11)
  source 1..1034: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21120 - RNA, 914 nt, synthetic construct
  misc_feature 1..914: note = mRNA product Design e-1 comprising derived and/or modified sequence from HRSV(Memphis-37)__AIY60641.1__M2-1 (wt)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21121 - RNA, 914 nt, synthetic construct
  misc_feature 1..914: note = mRNA product Design e-1 comprising derived and/or modified sequence from HRSV(Memphis-37)__AIY60641.1__M2-1 (opt1)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21122 - RNA, 914 nt, synthetic construct
  misc_feature 1..914: note = mRNA product Design e-1 comprising derived and/or modified sequence from HRSV(Memphis-37)__AIY60641.1__M2-1 (opt2)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21123 - RNA, 914 nt, synthetic construct
  misc_feature 1..914: note = mRNA product Design e-1 comprising derived and/or modified sequence from HRSV(Memphis-37)__AIY60641.1__M2-1 (opt3)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21124 - RNA, 914 nt, synthetic construct
  misc_feature 1..914: note = mRNA product Design e-1 comprising derived and/or modified sequence from HRSV(Memphis-37)__AIY60641.1__M2-1 (opt4)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21125 - RNA, 914 nt, synthetic construct
  misc_feature 1..914: note = mRNA product Design e-1 comprising derived and/or modified sequence from HRSV(Memphis-37)__AIY60641.1__M2-1 (opt5)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21126 - RNA, 914 nt, synthetic construct
  misc_feature 1..914: note = mRNA product Design e-1 comprising derived and/or modified sequence from HRSV(Memphis-37)__AIY60641.1__M2-1 (opt6)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21127 - RNA, 914 nt, synthetic construct
  misc_feature 1..914: note = mRNA product Design e-1 comprising derived and/or modified sequence from HRSV(Memphis-37)__AIY60641.1__M2-1 (opt11)
  source 1..914: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21128 - RNA, 896 nt, synthetic construct
  misc_feature 1..896: note = mRNA product Design e-2 comprising derived and/or modified sequence from HRSV(Memphis-37)__AIY60641.1__M2-1 (wt)
  source 1..896: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21129 - RNA, 896 nt, synthetic construct
  misc_feature 1..896: note = mRNA product Design e-2 comprising derived and/or modified sequence from HRSV(Memphis-37)__AIY60641.1__M2-1 (opt1)
  source 1..896: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21130 - RNA, 896 nt, synthetic construct
  misc_feature 1..896: note = mRNA product Design e-2 comprising derived and/or modified sequence from HRSV(Memphis-37)__AIY60641.1__M2-1 (opt2)
  source 1..896: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21131 - RNA, 896 nt, synthetic construct
  misc_feature 1..896: note = mRNA product Design e-2 comprising derived and/or modified sequence from HRSV(Memphis-37)__AIY60641.1__M2-1 (opt3)
  source 1..896: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21132 - RNA, 896 nt, synthetic construct
  misc_feature 1..896: note = mRNA product Design e-2 comprising derived and/or modified sequence from HRSV(Memphis-37)__AIY60641.1__M2-1 (opt4)
  source 1..896: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21133 - RNA, 896 nt, synthetic construct
  misc_feature 1..896: note = mRNA product Design e-2 comprising derived and/or modified sequence from HRSV(Memphis-37)__AIY60641.1__M2-1 (opt5)
  source 1..896: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21134 - RNA, 896 nt, synthetic construct
  misc_feature 1..896: note = mRNA product Design e-2 comprising derived and/or modified sequence from HRSV(Memphis-37)__AIY60641.1__M2-1 (opt6)
  source 1..896: mol_type = other RNA
gggagacccgtgacccggaagttgtacggctacgcgactttccctcccacaaaccctcgcgcccttcctttcctacttgggcccggcagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21135 - RNA, 896 nt, synthetic construct
  misc_feature 1..896: note = mRNA product Design e-2 comprising derived and/or modified sequence from HRSV(Memphis-37)__AIY60641.1__M2-1 (opt11)
  source 1..896: mol_type = other RNA
gggagacccgtgacccggaagttgtacggctacgcgactttccctcccacaaaccctcgcgcccttcctttcctacttgggcccggcagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21136 - RNA, 866 nt, synthetic construct
  misc_feature 1..866: note = mRNA product Design e-3 comprising derived and/or modified sequence from HRSV(Memphis-37)__AIY60641.1__M2-1 (wt)
  source 1..866: mol_type = other RNA
gggagactttcccattctgtagcagaatttggtgttgcctgtggtcttggtcccgcggagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21137 - RNA, 866 nt, synthetic construct
  misc_feature 1..866: note = mRNA product Design e-3 comprising derived and/or modified sequence from HRSV(Memphis-37)__AIY60641.1__M2-1 (opt1)
  source 1..866: mol_type = other RNA
gggagactttcccattctgtagcagaatttggtgttgcctgtggtcttggtcccgcggagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21138 - RNA, 866 nt, synthetic construct
  misc_feature 1..866: note = mRNA product Design e-3 comprising derived and/or modified sequence from HRSV(Memphis-37)__AIY60641.1__M2-1 (opt2)
  source 1..866: mol_type = other RNA
gggagactttcccattctgtagcagaatttggtgttgcctgtggtcttggtcccgcggagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21139 - RNA, 866 nt, synthetic construct
  misc_feature 1..866: note = mRNA product Design e-3 comprising derived and/or modified sequence from HRSV(Memphis-37)__AIY60641.1__M2-1 (opt3)
  source 1..866: mol_type = other RNA
gggagactttcccattctgtagcagaatttggtgttgcctgtggtcttggtcccgcggagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21140 - RNA, 866 nt, synthetic construct
  misc_feature 1..866: note = mRNA product Design e-3 comprising derived and/or modified sequence from HRSV(Memphis-37)__AIY60641.1__M2-1 (opt4)
  source 1..866: mol_type = other RNA
gggagactttcccattctgtagcagaatttggtgttgcctgtggtcttggtcccgcggagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21141 - RNA, 866 nt, synthetic construct
  misc_feature 1..866: note = mRNA product Design e-3 comprising derived and/or modified sequence from HRSV(Memphis-37)__AIY60641.1__M2-1 (opt5)
  source 1..866: mol_type = other RNA
gggagactttcccattctgtagcagaatttggtgttgcctgtggtcttggtcccgcggagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21142 - RNA, 866 nt, synthetic construct
  misc_feature 1..866: note = mRNA product Design e-3 comprising derived and/or modified sequence from HRSV(Memphis-37)__AIY60641.1__M2-1 (opt6)
  source 1..866: mol_type = other RNA
gggagactttcccattctgtagcagaatttggtgttgcctgtggtcttggtcccgcggagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21143 - RNA, 866 nt, synthetic construct
  misc_feature 1..866: note = mRNA product Design e-3 comprising derived and/or modified sequence from HRSV(Memphis-37)__AIY60641.1__M2-1 (opt11)
  source 1..866: mol_type = other RNA
gggagactttcccattctgtagcagaatttggtgttgcctgtggtcttggtcccgcggagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21144 - RNA, 920 nt, synthetic construct
  misc_feature 1..920: note = mRNA product Design e-4 comprising derived and/or modified sequence from HRSV(Memphis-37)__AIY60641.1__M2-1 (wt)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21145 - RNA, 920 nt, synthetic construct
  misc_feature 1..920: note = mRNA product Design e-4 comprising derived and/or modified sequence from HRSV(Memphis-37)__AIY60641.1__M2-1 (opt1)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21146 - RNA, 920 nt, synthetic construct
  misc_feature 1..920: note = mRNA product Design e-4 comprising derived and/or modified sequence from HRSV(Memphis-37)__AIY60641.1__M2-1 (opt2)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21147 - RNA, 920 nt, synthetic construct
  misc_feature 1..920: note = mRNA product Design e-4 comprising derived and/or modified sequence from HRSV(Memphis-37)__AIY60641.1__M2-1 (opt3)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21148 - RNA, 920 nt, synthetic construct
  misc_feature 1..920: note = mRNA product Design e-4 comprising derived and/or modified sequence from HRSV(Memphis-37)__AIY60641.1__M2-1 (opt4)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21149 - RNA, 920 nt, synthetic construct
  misc_feature 1..920: note = mRNA product Design e-4 comprising derived and/or modified sequence from HRSV(Memphis-37)__AIY60641.1__M2-1 (opt5)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21150 - RNA, 920 nt, synthetic construct
  misc_feature 1..920: note = mRNA product Design e-4 comprising derived and/or modified sequence from HRSV(Memphis-37)__AIY60641.1__M2-1 (opt6)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21151 - RNA, 920 nt, synthetic construct
  misc_feature 1..920: note = mRNA product Design e-4 comprising derived and/or modified sequence from HRSV(Memphis-37)__AIY60641.1__M2-1 (opt11)
  source 1..920: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21152 - RNA, 887 nt, synthetic construct
  misc_feature 1..887: note = mRNA product Design e-5 comprising derived and/or modified sequence from HRSV(Memphis-37)__AIY60641.1__M2-1 (wt)
  source 1..887: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21153 - RNA, 887 nt, synthetic construct
  misc_feature 1..887: note = mRNA product Design e-5 comprising derived and/or modified sequence from HRSV(Memphis-37)__AIY60641.1__M2-1 (opt1)
  source 1..887: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21154 - RNA, 887 nt, synthetic construct
  misc_feature 1..887: note = mRNA product Design e-5 comprising derived and/or modified sequence from HRSV(Memphis-37)__AIY60641.1__M2-1 (opt2)
  source 1..887: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21155 - RNA, 887 nt, synthetic construct
  misc_feature 1..887: note = mRNA product Design e-5 comprising derived and/or modified sequence from HRSV(Memphis-37)__AIY60641.1__M2-1 (opt3)
  source 1..887: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21156 - RNA, 887 nt, synthetic construct
  misc_feature 1..887: note = mRNA product Design e-5 comprising derived and/or modified sequence from HRSV(Memphis-37)__AIY60641.1__M2-1 (opt4)
  source 1..887: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21157 - RNA, 887 nt, synthetic construct
  misc_feature 1..887: note = mRNA product Design e-5 comprising derived and/or modified sequence from HRSV(Memphis-37)__AIY60641.1__M2-1 (opt5)
  source 1..887: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21158 - RNA, 887 nt, synthetic construct
  misc_feature 1..887: note = mRNA product Design e-5 comprising derived and/or modified sequence from HRSV(Memphis-37)__AIY60641.1__M2-1 (opt6)
  source 1..887: mol_type = other RNA
gggagagcggctcggccattttgtcccagtcagtccggaggctgcggctgcagaagtaccgcctgcggagtaactgcaaagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21159 - RNA, 887 nt, synthetic construct
  misc_feature 1..887: note = mRNA product Design e-5 comprising derived and/or modified sequence from HRSV(Memphis-37)__AIY60641.1__M2-1 (opt11)
  source 1..887: mol_type = other RNA
gggagagcggctcggccattttgtcccagtcagtccggaggctgcggctgcagaagtaccgcctgcggagtaactgcaaagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21160 - RNA, 954 nt, synthetic construct
  misc_feature 1..954: note = mRNA product Design e-6 comprising derived and/or modified sequence from HRSV(Memphis-37)__AIY60641.1__M2-1 (wt)
  source 1..954: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21161 - RNA, 954 nt, synthetic construct
  misc_feature 1..954: note = mRNA product Design e-6 comprising derived and/or modified sequence from HRSV(Memphis-37)__AIY60641.1__M2-1 (opt1)
  source 1..954: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21162 - RNA, 954 nt, synthetic construct
  misc_feature 1..954: note = mRNA product Design e-6 comprising derived and/or modified sequence from HRSV(Memphis-37)__AIY60641.1__M2-1 (opt2)
  source 1..954: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21163 - RNA, 954 nt, synthetic construct
  misc_feature 1..954: note = mRNA product Design e-6 comprising derived and/or modified sequence from HRSV(Memphis-37)__AIY60641.1__M2-1 (opt3)
  source 1..954: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21164 - RNA, 954 nt, synthetic construct
  misc_feature 1..954: note = mRNA product Design e-6 comprising derived and/or modified sequence from HRSV(Memphis-37)__AIY60641.1__M2-1 (opt4)
  source 1..954: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21165 - RNA, 954 nt, synthetic construct
  misc_feature 1..954: note = mRNA product Design e-6 comprising derived and/or modified sequence from HRSV(Memphis-37)__AIY60641.1__M2-1 (opt5)
  source 1..954: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21166 - RNA, 954 nt, synthetic construct
  misc_feature 1..954: note = mRNA product Design e-6 comprising derived and/or modified sequence from HRSV(Memphis-37)__AIY60641.1__M2-1 (opt6)
  source 1..954: mol_type = other RNA
gggagagcggctcggccattttgtcccagtcagtccggaggctgcggctgcagaagtaccgcctgcggagtaactgcaaagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21167 - RNA, 954 nt, synthetic construct
  misc_feature 1..954: note = mRNA product Design e-6 comprising derived and/or modified sequence from HRSV(Memphis-37)__AIY60641.1__M2-1 (opt11)
  source 1..954: mol_type = other RNA
gggagagcggctcggccattttgtcccagtcagtccggaggctgcggctgcagaagtaccgcctgcggagtaactgcaaagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21168 - RNA, 1170 nt, synthetic construct
  misc_feature 1..1170: note = mRNA product Design f-1 comprising derived and/or modified sequence from HRSV(Memphis-37)__AIY60641.1__M2-1 (wt)
  source 1..1170: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21169 - RNA, 1170 nt, synthetic construct
  misc_feature 1..1170: note = mRNA product Design f-1 comprising derived and/or modified sequence from HRSV(Memphis-37)__AIY60641.1__M2-1 (opt1)
  source 1..1170: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21170 - RNA, 1170 nt, synthetic construct
  misc_feature 1..1170: note = mRNA product Design f-1 comprising derived and/or modified sequence from HRSV(Memphis-37)__AIY60641.1__M2-1 (opt2)
  source 1..1170: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21171 - RNA, 1170 nt, synthetic construct
  misc_feature 1..1170: note = mRNA product Design f-1 comprising derived and/or modified sequence from HRSV(Memphis-37)__AIY60641.1__M2-1 (opt3)
  source 1..1170: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21172 - RNA, 1170 nt, synthetic construct
  misc_feature 1..1170: note = mRNA product Design f-1 comprising derived and/or modified sequence from HRSV(Memphis-37)__AIY60641.1__M2-1 (opt4)
  source 1..1170: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21173 - RNA, 1170 nt, synthetic construct
  misc_feature 1..1170: note = mRNA product Design f-1 comprising derived and/or modified sequence from HRSV(Memphis-37)__AIY60641.1__M2-1 (opt5)
  source 1..1170: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21174 - RNA, 1170 nt, synthetic construct
  misc_feature 1..1170: note = mRNA product Design f-1 comprising derived and/or modified sequence from HRSV(Memphis-37)__AIY60641.1__M2-1 (opt6)
  source 1..1170: mol_type = other RNA
gggagagcggctcggccattttgtcccagtcagtccggaggctgcggctgcagaagtaccgcctgcggagtaactgcaaagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21175 - RNA, 1170 nt, synthetic construct
  misc_feature 1..1170: note = mRNA product Design f-1 comprising derived and/or modified sequence from HRSV(Memphis-37)__AIY60641.1__M2-1 (opt11)
  source 1..1170: mol_type = other RNA
gggagagcggctcggccattttgtcccagtcagtccggaggctgcggctgcagaagtaccgcctgcggagtaactgcaaagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21176 - RNA, 950 nt, synthetic construct
  misc_feature 1..950: note = mRNA product Design f-2 comprising derived and/or modified sequence from HRSV(Memphis-37)__AIY60641.1__M2-1 (wt)
  source 1..950: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21177 - RNA, 950 nt, synthetic construct
  misc_feature 1..950: note = mRNA product Design f-2 comprising derived and/or modified sequence from HRSV(Memphis-37)__AIY60641.1__M2-1 (opt1)
  source 1..950: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21178 - RNA, 950 nt, synthetic construct
  misc_feature 1..950: note = mRNA product Design f-2 comprising derived and/or modified sequence from HRSV(Memphis-37)__AIY60641.1__M2-1 (opt2)
  source 1..950: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21179 - RNA, 950 nt, synthetic construct
  misc_feature 1..950: note = mRNA product Design f-2 comprising derived and/or modified sequence from HRSV(Memphis-37)__AIY60641.1__M2-1 (opt3)
  source 1..950: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21180 - RNA, 950 nt, synthetic construct
  misc_feature 1..950: note = mRNA product Design f-2 comprising derived and/or modified sequence from HRSV(Memphis-37)__AIY60641.1__M2-1 (opt4)
  source 1..950: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21181 - RNA, 950 nt, synthetic construct
  misc_feature 1..950: note = mRNA product Design f-2 comprising derived and/or modified sequence from HRSV(Memphis-37)__AIY60641.1__M2-1 (opt5)
  source 1..950: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21182 - RNA, 950 nt, synthetic construct
  misc_feature 1..950: note = mRNA product Design f-2 comprising derived and/or modified sequence from HRSV(Memphis-37)__AIY60641.1__M2-1 (opt6)
  source 1..950: mol_type = other RNA
gggagagcggctcggccattttgtcccagtcagtccggaggctgcggctgcagaagtaccgcctgcggagtaactgcaaagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21183 - RNA, 950 nt, synthetic construct
  misc_feature 1..950: note = mRNA product Design f-2 comprising derived and/or modified sequence from HRSV(Memphis-37)__AIY60641.1__M2-1 (opt11)
  source 1..950: mol_type = other RNA
gggagagcggctcggccattttgtcccagtcagtccggaggctgcggctgcagaagtaccgcctgcggagtaactgcaaagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21184 - RNA, 941 nt, synthetic construct
  misc_feature 1..941: note = mRNA product Design f-3 comprising derived and/or modified sequence from HRSV(Memphis-37)__AIY60641.1__M2-1 (wt)
  source 1..941: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21185 - RNA, 941 nt, synthetic construct
  misc_feature 1..941: note = mRNA product Design f-3 comprising derived and/or modified sequence from HRSV(Memphis-37)__AIY60641.1__M2-1 (opt1)
  source 1..941: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21186 - RNA, 941 nt, synthetic construct
  misc_feature 1..941: note = mRNA product Design f-3 comprising derived and/or modified sequence from HRSV(Memphis-37)__AIY60641.1__M2-1 (opt2)
  source 1..941: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21187 - RNA, 941 nt, synthetic construct
  misc_feature 1..941: note = mRNA product Design f-3 comprising derived and/or modified sequence from HRSV(Memphis-37)__AIY60641.1__M2-1 (opt3)
  source 1..941: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21188 - RNA, 941 nt, synthetic construct
  misc_feature 1..941: note = mRNA product Design f-3 comprising derived and/or modified sequence from HRSV(Memphis-37)__AIY60641.1__M2-1 (opt4)
  source 1..941: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21189 - RNA, 941 nt, synthetic construct
  misc_feature 1..941: note = mRNA product Design f-3 comprising derived and/or modified sequence from HRSV(Memphis-37)__AIY60641.1__M2-1 (opt5)
  source 1..941: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21190 - RNA, 941 nt, synthetic construct
  misc_feature 1..941: note = mRNA product Design f-3 comprising derived and/or modified sequence from HRSV(Memphis-37)__AIY60641.1__M2-1 (opt6)
  source 1..941: mol_type = other RNA
gggagagtcccgcagtcggcgtccagcggctctgcttgttcgtgtgtgtgtcgttgcaggccttattcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21191 - RNA, 941 nt, synthetic construct
  misc_feature 1..941: note = mRNA product Design f-3 comprising derived and/or modified sequence from HRSV(Memphis-37)__AIY60641.1__M2-1 (opt11)
  source 1..941: mol_type = other RNA
gggagagtcccgcagtcggcgtccagcggctctgcttgttcgtgtgtgtgtcgttgcaggccttattcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21192 - RNA, 1157 nt, synthetic construct
  misc_feature 1..1157: note = mRNA product Design f-4 comprising derived and/or modified sequence from HRSV(Memphis-37)__AIY60641.1__M2-1 (wt)
  source 1..1157: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21193 - RNA, 1157 nt, synthetic construct
  misc_feature 1..1157: note = mRNA product Design f-4 comprising derived and/or modified sequence from HRSV(Memphis-37)__AIY60641.1__M2-1 (opt1)
  source 1..1157: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21194 - RNA, 1157 nt, synthetic construct
  misc_feature 1..1157: note = mRNA product Design f-4 comprising derived and/or modified sequence from HRSV(Memphis-37)__AIY60641.1__M2-1 (opt2)
  source 1..1157: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21195 - RNA, 1157 nt, synthetic construct
  misc_feature 1..1157: note = mRNA product Design f-4 comprising derived and/or modified sequence from HRSV(Memphis-37)__AIY60641.1__M2-1 (opt3)
  source 1..1157: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21196 - RNA, 1157 nt, synthetic construct
  misc_feature 1..1157: note = mRNA product Design f-4 comprising derived and/or modified sequence from HRSV(Memphis-37)__AIY60641.1__M2-1 (opt4)
  source 1..1157: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21197 - RNA, 1157 nt, synthetic construct
  misc_feature 1..1157: note = mRNA product Design f-4 comprising derived and/or modified sequence from HRSV(Memphis-37)__AIY60641.1__M2-1 (opt5)
  source 1..1157: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21198 - RNA, 1157 nt, synthetic construct
  misc_feature 1..1157: note = mRNA product Design f-4 comprising derived and/or modified sequence from HRSV(Memphis-37)__AIY60641.1__M2-1 (opt6)
  source 1..1157: mol_type = other RNA
gggagagtcccgcagtcggcgtccagcggctctgcttgttcgtgtgtgtgtcgttgcaggccttattcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21199 - RNA, 1157 nt, synthetic construct
  misc_feature 1..1157: note = mRNA product Design f-4 comprising derived and/or modified sequence from HRSV(Memphis-37)__AIY60641.1__M2-1 (opt11)
  source 1..1157: mol_type = other RNA
gggagagtcccgcagtcggcgtccagcggctctgcttgttcgtgtgtgtgtcgttgcaggccttattcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21200 - RNA, 933 nt, synthetic construct
  misc_feature 1..933: note = mRNA product Design f-5 comprising derived and/or modified sequence from HRSV(Memphis-37)__AIY60641.1__M2-1 (wt)
  source 1..933: mol_type = other RNA
gggagactttcccattctgtagcagaatttggtgttgcctgtggtcttggtcccgcggagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21201 - RNA, 933 nt, synthetic construct
  misc_feature 1..933: note = mRNA product Design f-5 comprising derived and/or modified sequence from HRSV(Memphis-37)__AIY60641.1__M2-1 (opt1)
  source 1..933: mol_type = other RNA
gggagactttcccattctgtagcagaatttggtgttgcctgtggtcttggtcccgcggagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21202 - RNA, 933 nt, synthetic construct
  misc_feature 1..933: note = mRNA product Design f-5 comprising derived and/or modified sequence from HRSV(Memphis-37)__AIY60641.1__M2-1 (opt2)
  source 1..933: mol_type = other RNA
gggagactttcccattctgtagcagaatttggtgttgcctgtggtcttggtcccgcggagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21203 - RNA, 933 nt, synthetic construct
  misc_feature 1..933: note = mRNA product Design f-5 comprising derived and/or modified sequence from HRSV(Memphis-37)__AIY60641.1__M2-1 (opt3)
  source 1..933: mol_type = other RNA
gggagactttcccattctgtagcagaatttggtgttgcctgtggtcttggtcccgcggagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21204 - RNA, 933 nt, synthetic construct
  misc_feature 1..933: note = mRNA product Design f-5 comprising derived and/or modified sequence from HRSV(Memphis-37)__AIY60641.1__M2-1 (opt4)
  source 1..933: mol_type = other RNA
gggagactttcccattctgtagcagaatttggtgttgcctgtggtcttggtcccgcggagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21205 - RNA, 933 nt, synthetic construct
  misc_feature 1..933: note = mRNA product Design f-5 comprising derived and/or modified sequence from HRSV(Memphis-37)__AIY60641.1__M2-1 (opt5)
  source 1..933: mol_type = other RNA
gggagactttcccattctgtagcagaatttggtgttgcctgtggtcttggtcccgcggagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21206 - RNA, 933 nt, synthetic construct
  misc_feature 1..933: note = mRNA product Design f-5 comprising derived and/or modified sequence from HRSV(Memphis-37)__AIY60641.1__M2-1 (opt6)
  source 1..933: mol_type = other RNA
gggagactttcccattctgtagcagaatttggtgttgcctgtggtcttggtcccgcggagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21207 - RNA, 933 nt, synthetic construct
  misc_feature 1..933: note = mRNA product Design f-5 comprising derived and/or modified sequence from HRSV(Memphis-37)__AIY60641.1__M2-1 (opt11)
  source 1..933: mol_type = other RNA
gggagactttcccattctgtagcagaatttggtgttgcctgtggtcttggtcccgcggagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21208 - RNA, 929 nt, synthetic construct
  misc_feature 1..929: note = mRNA product Design g-1 comprising derived and/or modified sequence from HRSV(Memphis-37)__AIY60641.1__M2-1 (wt)
  source 1..929: mol_type = other RNA
gggagactttcccattctgtagcagaatttggtgttgcctgtggtcttggtcccgcggagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21209 - RNA, 929 nt, synthetic construct
  misc_feature 1..929: note = mRNA product Design g-1 comprising derived and/or modified sequence from HRSV(Memphis-37)__AIY60641.1__M2-1 (opt1)
  source 1..929: mol_type = other RNA
gggagactttcccattctgtagcagaatttggtgttgcctgtggtcttggtcccgcggagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21210 - RNA, 929 nt, synthetic construct
  misc_feature 1..929: note = mRNA product Design g-1 comprising derived and/or modified sequence from HRSV(Memphis-37)__AIY60641.1__M2-1 (opt2)
  source 1..929: mol_type = other RNA
gggagactttcccattctgtagcagaatttggtgttgcctgtggtcttggtcccgcggagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21211 - RNA, 929 nt, synthetic construct
  misc_feature 1..929: note = mRNA product Design g-1 comprising derived and/or modified sequence from HRSV(Memphis-37)__AIY60641.1__M2-1 (opt3)
  source 1..929: mol_type = other RNA
gggagactttcccattctgtagcagaatttggtgttgcctgtggtcttggtcccgcggagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21212 - RNA, 929 nt, synthetic construct
  misc_feature 1..929: note = mRNA product Design g-1 comprising derived and/or modified sequence from HRSV(Memphis-37)__AIY60641.1__M2-1 (opt4)
  source 1..929: mol_type = other RNA
gggagactttcccattctgtagcagaatttggtgttgcctgtggtcttggtcccgcggagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21213 - RNA, 929 nt, synthetic construct
  misc_feature 1..929: note = mRNA product Design g-1 comprising derived and/or modified sequence from HRSV(Memphis-37)__AIY60641.1__M2-1 (opt5)
  source 1..929: mol_type = other RNA
gggagactttcccattctgtagcagaatttggtgttgcctgtggtcttggtcccgcggagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21214 - RNA, 929 nt, synthetic construct
  misc_feature 1..929: note = mRNA product Design g-1 comprising derived and/or modified sequence from HRSV(Memphis-37)__AIY60641.1__M2-1 (opt6)
  source 1..929: mol_type = other RNA
gggagactttcccattctgtagcagaatttggtgttgcctgtggtcttggtcccgcggagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21215 - RNA, 929 nt, synthetic construct
  misc_feature 1..929: note = mRNA product Design g-1 comprising derived and/or modified sequence from HRSV(Memphis-37)__AIY60641.1__M2-1 (opt11)
  source 1..929: mol_type = other RNA
gggagactttcccattctgtagcagaatttggtgttgcctgtggtcttggtcccgcggagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21216 - RNA, 944 nt, synthetic construct
  misc_feature 1..944: note = mRNA product Design g-2 comprising derived and/or modified sequence from HRSV(Memphis-37)__AIY60641.1__M2-1 (wt)
  source 1..944: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21217 - RNA, 944 nt, synthetic construct
  misc_feature 1..944: note = mRNA product Design g-2 comprising derived and/or modified sequence from HRSV(Memphis-37)__AIY60641.1__M2-1 (opt1)
  source 1..944: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21218 - RNA, 944 nt, synthetic construct
  misc_feature 1..944: note = mRNA product Design g-2 comprising derived and/or modified sequence from HRSV(Memphis-37)__AIY60641.1__M2-1 (opt2)
  source 1..944: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21219 - RNA, 944 nt, synthetic construct
  misc_feature 1..944: note = mRNA product Design g-2 comprising derived and/or modified sequence from HRSV(Memphis-37)__AIY60641.1__M2-1 (opt3)
  source 1..944: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21220 - RNA, 944 nt, synthetic construct
  misc_feature 1..944: note = mRNA product Design g-2 comprising derived and/or modified sequence from HRSV(Memphis-37)__AIY60641.1__M2-1 (opt4)
  source 1..944: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21221 - RNA, 944 nt, synthetic construct
  misc_feature 1..944: note = mRNA product Design g-2 comprising derived and/or modified sequence from HRSV(Memphis-37)__AIY60641.1__M2-1 (opt5)
  source 1..944: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21222 - RNA, 944 nt, synthetic construct
  misc_feature 1..944: note = mRNA product Design g-2 comprising derived and/or modified sequence from HRSV(Memphis-37)__AIY60641.1__M2-1 (opt6)
  source 1..944: mol_type = other RNA
gggagagtccgctcagccaggttgcagaagcggcttagcgtgtgtcctaatcttctctctgcgtgtaggtaggcctgtgccgcaaacaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21223 - RNA, 944 nt, synthetic construct
  misc_feature 1..944: note = mRNA product Design g-2 comprising derived and/or modified sequence from HRSV(Memphis-37)__AIY60641.1__M2-1 (opt11)
  source 1..944: mol_type = other RNA
gggagagtccgctcagccaggttgcagaagcggcttagcgtgtgtcctaatcttctctctgcgtgtaggtaggcctgtgccgcaaacaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21224 - RNA, 1176 nt, synthetic construct
  misc_feature 1..1176: note = mRNA product Design g-3 comprising derived and/or modified sequence from HRSV(Memphis-37)__AIY60641.1__M2-1 (wt)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21225 - RNA, 1176 nt, synthetic construct
  misc_feature 1..1176: note = mRNA product Design g-3 comprising derived and/or modified sequence from HRSV(Memphis-37)__AIY60641.1__M2-1 (opt1)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21226 - RNA, 1176 nt, synthetic construct
  misc_feature 1..1176: note = mRNA product Design g-3 comprising derived and/or modified sequence from HRSV(Memphis-37)__AIY60641.1__M2-1 (opt2)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21227 - RNA, 1176 nt, synthetic construct
  misc_feature 1..1176: note = mRNA product Design g-3 comprising derived and/or modified sequence from HRSV(Memphis-37)__AIY60641.1__M2-1 (opt3)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21228 - RNA, 1176 nt, synthetic construct
  misc_feature 1..1176: note = mRNA product Design g-3 comprising derived and/or modified sequence from HRSV(Memphis-37)__AIY60641.1__M2-1 (opt4)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21229 - RNA, 1176 nt, synthetic construct
  misc_feature 1..1176: note = mRNA product Design g-3 comprising derived and/or modified sequence from HRSV(Memphis-37)__AIY60641.1__M2-1 (opt5)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21230 - RNA, 1176 nt, synthetic construct
  misc_feature 1..1176: note = mRNA product Design g-3 comprising derived and/or modified sequence from HRSV(Memphis-37)__AIY60641.1__M2-1 (opt6)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21231 - RNA, 1176 nt, synthetic construct
  misc_feature 1..1176: note = mRNA product Design g-3 comprising derived and/or modified sequence from HRSV(Memphis-37)__AIY60641.1__M2-1 (opt11)
  source 1..1176: mol_type = other RNA
gggagagtccgctcagccaggttgcagaagcggcttagcgtgtgtcctaatcttctctctgcgtgtaggtaggcctgtgccgcaaacaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21232 - RNA, 971 nt, synthetic construct
  misc_feature 1..971: note = mRNA product Design g-4 comprising derived and/or modified sequence from HRSV(Memphis-37)__AIY60641.1__M2-1 (wt)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21233 - RNA, 971 nt, synthetic construct
  misc_feature 1..971: note = mRNA product Design g-4 comprising derived and/or modified sequence from HRSV(Memphis-37)__AIY60641.1__M2-1 (opt1)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21234 - RNA, 971 nt, synthetic construct
  misc_feature 1..971: note = mRNA product Design g-4 comprising derived and/or modified sequence from HRSV(Memphis-37)__AIY60641.1__M2-1 (opt2)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21235 - RNA, 971 nt, synthetic construct
  misc_feature 1..971: note = mRNA product Design g-4 comprising derived and/or modified sequence from HRSV(Memphis-37)__AIY60641.1__M2-1 (opt3)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21236 - RNA, 971 nt, synthetic construct
  misc_feature 1..971: note = mRNA product Design g-4 comprising derived and/or modified sequence from HRSV(Memphis-37)__AIY60641.1__M2-1 (opt4)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21237 - RNA, 971 nt, synthetic construct
  misc_feature 1..971: note = mRNA product Design g-4 comprising derived and/or modified sequence from HRSV(Memphis-37)__AIY60641.1__M2-1 (opt5)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21238 - RNA, 971 nt, synthetic construct
  misc_feature 1..971: note = mRNA product Design g-4 comprising derived and/or modified sequence from HRSV(Memphis-37)__AIY60641.1__M2-1 (opt6)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21239 - RNA, 971 nt, synthetic construct
  misc_feature 1..971: note = mRNA product Design g-4 comprising derived and/or modified sequence from HRSV(Memphis-37)__AIY60641.1__M2-1 (opt11)
  source 1..971: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21240 - RNA, 947 nt, synthetic construct
  misc_feature 1..947: note = mRNA product Design g-5 comprising derived and/or modified sequence from HRSV(Memphis-37)__AIY60641.1__M2-1 (wt)
  source 1..947: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21241 - RNA, 947 nt, synthetic construct
  misc_feature 1..947: note = mRNA product Design g-5 comprising derived and/or modified sequence from HRSV(Memphis-37)__AIY60641.1__M2-1 (opt1)
  source 1..947: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21242 - RNA, 947 nt, synthetic construct
  misc_feature 1..947: note = mRNA product Design g-5 comprising derived and/or modified sequence from HRSV(Memphis-37)__AIY60641.1__M2-1 (opt2)
  source 1..947: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21243 - RNA, 947 nt, synthetic construct
  misc_feature 1..947: note = mRNA product Design g-5 comprising derived and/or modified sequence from HRSV(Memphis-37)__AIY60641.1__M2-1 (opt3)
  source 1..947: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21244 - RNA, 947 nt, synthetic construct
  misc_feature 1..947: note = mRNA product Design g-5 comprising derived and/or modified sequence from HRSV(Memphis-37)__AIY60641.1__M2-1 (opt4)
  source 1..947: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21245 - RNA, 947 nt, synthetic construct
  misc_feature 1..947: note = mRNA product Design g-5 comprising derived and/or modified sequence from HRSV(Memphis-37)__AIY60641.1__M2-1 (opt5)
  source 1..947: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21246 - RNA, 947 nt, synthetic construct
  misc_feature 1..947: note = mRNA product Design g-5 comprising derived and/or modified sequence from HRSV(Memphis-37)__AIY60641.1__M2-1 (opt6)
  source 1..947: mol_type = other RNA
gggagacccgtgacccggaagttgtacggctacgcgactttccctcccacaaaccctcgcgcccttcctttcctacttgggcccggcagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21247 - RNA, 947 nt, synthetic construct
  misc_feature 1..947: note = mRNA product Design g-5 comprising derived and/or modified sequence from HRSV(Memphis-37)__AIY60641.1__M2-1 (opt11)
  source 1..947: mol_type = other RNA
gggagacccgtgacccggaagttgtacggctacgcgactttccctcccacaaaccctcgcgcccttcctttcctacttgggcccggcagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21248 - RNA, 963 nt, synthetic construct
  misc_feature 1..963: note = mRNA product Design h-1 comprising derived and/or modified sequence from HRSV(Memphis-37)__AIY60641.1__M2-1 (wt)
  source 1..963: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21249 - RNA, 963 nt, synthetic construct
  misc_feature 1..963: note = mRNA product Design h-1 comprising derived and/or modified sequence from HRSV(Memphis-37)__AIY60641.1__M2-1 (opt1)
  source 1..963: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21250 - RNA, 963 nt, synthetic construct
  misc_feature 1..963: note = mRNA product Design h-1 comprising derived and/or modified sequence from HRSV(Memphis-37)__AIY60641.1__M2-1 (opt2)
  source 1..963: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21251 - RNA, 963 nt, synthetic construct
  misc_feature 1..963: note = mRNA product Design h-1 comprising derived and/or modified sequence from HRSV(Memphis-37)__AIY60641.1__M2-1 (opt3)
  source 1..963: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21252 - RNA, 963 nt, synthetic construct
  misc_feature 1..963: note = mRNA product Design h-1 comprising derived and/or modified sequence from HRSV(Memphis-37)__AIY60641.1__M2-1 (opt4)
  source 1..963: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21253 - RNA, 963 nt, synthetic construct
  misc_feature 1..963: note = mRNA product Design h-1 comprising derived and/or modified sequence from HRSV(Memphis-37)__AIY60641.1__M2-1 (opt5)
  source 1..963: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21254 - RNA, 963 nt, synthetic construct
  misc_feature 1..963: note = mRNA product Design h-1 comprising derived and/or modified sequence from HRSV(Memphis-37)__AIY60641.1__M2-1 (opt6)
  source 1..963: mol_type = other RNA
gggagacccgtgacccggaagttgtacggctacgcgactttccctcccacaaaccctcgcgcccttcctttcctacttgggcccggcagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21255 - RNA, 963 nt, synthetic construct
  misc_feature 1..963: note = mRNA product Design h-1 comprising derived and/or modified sequence from HRSV(Memphis-37)__AIY60641.1__M2-1 (opt11)
  source 1..963: mol_type = other RNA
gggagacccgtgacccggaagttgtacggctacgcgactttccctcccacaaaccctcgcgcccttcctttcctacttgggcccggcagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21256 - RNA, 1179 nt, synthetic construct
  misc_feature 1..1179: note = mRNA product Design h-2 comprising derived and/or modified sequence from HRSV(Memphis-37)__AIY60641.1__M2-1 (wt)
  source 1..1179: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21257 - RNA, 1179 nt, synthetic construct
  misc_feature 1..1179: note = mRNA product Design h-2 comprising derived and/or modified sequence from HRSV(Memphis-37)__AIY60641.1__M2-1 (opt1)
  source 1..1179: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21258 - RNA, 1179 nt, synthetic construct
  misc_feature 1..1179: note = mRNA product Design h-2 comprising derived and/or modified sequence from HRSV(Memphis-37)__AIY60641.1__M2-1 (opt2)
  source 1..1179: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21259 - RNA, 1179 nt, synthetic construct
  misc_feature 1..1179: note = mRNA product Design h-2 comprising derived and/or modified sequence from HRSV(Memphis-37)__AIY60641.1__M2-1 (opt3)
  source 1..1179: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21260 - RNA, 1179 nt, synthetic construct
  misc_feature 1..1179: note = mRNA product Design h-2 comprising derived and/or modified sequence from HRSV(Memphis-37)__AIY60641.1__M2-1 (opt4)
  source 1..1179: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21261 - RNA, 1179 nt, synthetic construct
  misc_feature 1..1179: note = mRNA product Design h-2 comprising derived and/or modified sequence from HRSV(Memphis-37)__AIY60641.1__M2-1 (opt5)
  source 1..1179: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21262 - RNA, 1179 nt, synthetic construct
  misc_feature 1..1179: note = mRNA product Design h-2 comprising derived and/or modified sequence from HRSV(Memphis-37)__AIY60641.1__M2-1 (opt6)
  source 1..1179: mol_type = other RNA
gggagacccgtgacccggaagttgtacggctacgcgactttccctcccacaaaccctcgcgcccttcctttcctacttgggcccggcagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21263 - RNA, 1179 nt, synthetic construct
  misc_feature 1..1179: note = mRNA product Design h-2 comprising derived and/or modified sequence from HRSV(Memphis-37)__AIY60641.1__M2-1 (opt11)
  source 1..1179: mol_type = other RNA
gggagacccgtgacccggaagttgtacggctacgcgactttccctcccacaaaccctcgcgcccttcctttcctacttgggcccggcagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21264 - RNA, 959 nt, synthetic construct
  misc_feature 1..959: note = mRNA product Design h-3 comprising derived and/or modified sequence from HRSV(Memphis-37)__AIY60641.1__M2-1 (wt)
  source 1..959: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21265 - RNA, 959 nt, synthetic construct
  misc_feature 1..959: note = mRNA product Design h-3 comprising derived and/or modified sequence from HRSV(Memphis-37)__AIY60641.1__M2-1 (opt1)
  source 1..959: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21266 - RNA, 959 nt, synthetic construct
  misc_feature 1..959: note = mRNA product Design h-3 comprising derived and/or modified sequence from HRSV(Memphis-37)__AIY60641.1__M2-1 (opt2)
  source 1..959: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21267 - RNA, 959 nt, synthetic construct
  misc_feature 1..959: note = mRNA product Design h-3 comprising derived and/or modified sequence from HRSV(Memphis-37)__AIY60641.1__M2-1 (opt3)
  source 1..959: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21268 - RNA, 959 nt, synthetic construct
  misc_feature 1..959: note = mRNA product Design h-3 comprising derived and/or modified sequence from HRSV(Memphis-37)__AIY60641.1__M2-1 (opt4)
  source 1..959: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21269 - RNA, 959 nt, synthetic construct
  misc_feature 1..959: note = mRNA product Design h-3 comprising derived and/or modified sequence from HRSV(Memphis-37)__AIY60641.1__M2-1 (opt5)
  source 1..959: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21270 - RNA, 959 nt, synthetic construct
  misc_feature 1..959: note = mRNA product Design h-3 comprising derived and/or modified sequence from HRSV(Memphis-37)__AIY60641.1__M2-1 (opt6)
  source 1..959: mol_type = other RNA
gggagacccgtgacccggaagttgtacggctacgcgactttccctcccacaaaccctcgcgcccttcctttcctacttgggcccggcagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21271 - RNA, 959 nt, synthetic construct
  misc_feature 1..959: note = mRNA product Design h-3 comprising derived and/or modified sequence from HRSV(Memphis-37)__AIY60641.1__M2-1 (opt11)
  source 1..959: mol_type = other RNA
gggagacccgtgacccggaagttgtacggctacgcgactttccctcccacaaaccctcgcgcccttcctttcctacttgggcccggcagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21272 - RNA, 1022 nt, synthetic construct
  misc_feature 1..1022: note = mRNA product Design h-4 comprising derived and/or modified sequence from HRSV(Memphis-37)__AIY60641.1__M2-1 (wt)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21273 - RNA, 1022 nt, synthetic construct
  misc_feature 1..1022: note = mRNA product Design h-4 comprising derived and/or modified sequence from HRSV(Memphis-37)__AIY60641.1__M2-1 (opt1)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21274 - RNA, 1022 nt, synthetic construct
  misc_feature 1..1022: note = mRNA product Design h-4 comprising derived and/or modified sequence from HRSV(Memphis-37)__AIY60641.1__M2-1 (opt2)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21275 - RNA, 1022 nt, synthetic construct
  misc_feature 1..1022: note = mRNA product Design h-4 comprising derived and/or modified sequence from HRSV(Memphis-37)__AIY60641.1__M2-1 (opt3)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21276 - RNA, 1022 nt, synthetic construct
  misc_feature 1..1022: note = mRNA product Design h-4 comprising derived and/or modified sequence from HRSV(Memphis-37)__AIY60641.1__M2-1 (opt4)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21277 - RNA, 1022 nt, synthetic construct
  misc_feature 1..1022: note = mRNA product Design h-4 comprising derived and/or modified sequence from HRSV(Memphis-37)__AIY60641.1__M2-1 (opt5)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21278 - RNA, 1022 nt, synthetic construct
  misc_feature 1..1022: note = mRNA product Design h-4 comprising derived and/or modified sequence from HRSV(Memphis-37)__AIY60641.1__M2-1 (opt6)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21279 - RNA, 1022 nt, synthetic construct
  misc_feature 1..1022: note = mRNA product Design h-4 comprising derived and/or modified sequence from HRSV(Memphis-37)__AIY60641.1__M2-1 (opt11)
  source 1..1022: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21280 - RNA, 1038 nt, synthetic construct
  misc_feature 1..1038: note = mRNA product Design h-5 comprising derived and/or modified sequence from HRSV(Memphis-37)__AIY60641.1__M2-1 (wt)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21281 - RNA, 1038 nt, synthetic construct
  misc_feature 1..1038: note = mRNA product Design h-5 comprising derived and/or modified sequence from HRSV(Memphis-37)__AIY60641.1__M2-1 (opt1)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21282 - RNA, 1038 nt, synthetic construct
  misc_feature 1..1038: note = mRNA product Design h-5 comprising derived and/or modified sequence from HRSV(Memphis-37)__AIY60641.1__M2-1 (opt2)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21283 - RNA, 1038 nt, synthetic construct
  misc_feature 1..1038: note = mRNA product Design h-5 comprising derived and/or modified sequence from HRSV(Memphis-37)__AIY60641.1__M2-1 (opt3)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21284 - RNA, 1038 nt, synthetic construct
  misc_feature 1..1038: note = mRNA product Design h-5 comprising derived and/or modified sequence from HRSV(Memphis-37)__AIY60641.1__M2-1 (opt4)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21285 - RNA, 1038 nt, synthetic construct
  misc_feature 1..1038: note = mRNA product Design h-5 comprising derived and/or modified sequence from HRSV(Memphis-37)__AIY60641.1__M2-1 (opt5)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21286 - RNA, 1038 nt, synthetic construct
  misc_feature 1..1038: note = mRNA product Design h-5 comprising derived and/or modified sequence from HRSV(Memphis-37)__AIY60641.1__M2-1 (opt6)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21287 - RNA, 1038 nt, synthetic construct
  misc_feature 1..1038: note = mRNA product Design h-5 comprising derived and/or modified sequence from HRSV(Memphis-37)__AIY60641.1__M2-1 (opt11)
  source 1..1038: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21288 - RNA, 971 nt, synthetic construct
  misc_feature 1..971: note = mRNA product Design i-1 comprising derived and/or modified sequence from HRSV(Memphis-37)__AIY60641.1__M2-1 (wt)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21289 - RNA, 971 nt, synthetic construct
  misc_feature 1..971: note = mRNA product Design i-1 comprising derived and/or modified sequence from HRSV(Memphis-37)__AIY60641.1__M2-1 (opt1)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21290 - RNA, 971 nt, synthetic construct
  misc_feature 1..971: note = mRNA product Design i-1 comprising derived and/or modified sequence from HRSV(Memphis-37)__AIY60641.1__M2-1 (opt2)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21291 - RNA, 971 nt, synthetic construct
  misc_feature 1..971: note = mRNA product Design i-1 comprising derived and/or modified sequence from HRSV(Memphis-37)__AIY60641.1__M2-1 (opt3)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21292 - RNA, 971 nt, synthetic construct
  misc_feature 1..971: note = mRNA product Design i-1 comprising derived and/or modified sequence from HRSV(Memphis-37)__AIY60641.1__M2-1 (opt4)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21293 - RNA, 971 nt, synthetic construct
  misc_feature 1..971: note = mRNA product Design i-1 comprising derived and/or modified sequence from HRSV(Memphis-37)__AIY60641.1__M2-1 (opt5)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21294 - RNA, 971 nt, synthetic construct
  misc_feature 1..971: note = mRNA product Design i-1 comprising derived and/or modified sequence from HRSV(Memphis-37)__AIY60641.1__M2-1 (opt6)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21295 - RNA, 971 nt, synthetic construct
  misc_feature 1..971: note = mRNA product Design i-1 comprising derived and/or modified sequence from HRSV(Memphis-37)__AIY60641.1__M2-1 (opt11)
  source 1..971: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21296 - RNA, 971 nt, synthetic construct
  misc_feature 1..971: note = mRNA product Design i-2 comprising derived and/or modified sequence from HRSV(Memphis-37)__AIY60641.1__M2-1 (wt)
  source 1..971: mol_type = other RNA
gggagaggcgctgcctacggaggtggcagccatctccttctcggcatcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21297 - RNA, 971 nt, synthetic construct
  misc_feature 1..971: note = mRNA product Design i-2 comprising derived and/or modified sequence from HRSV(Memphis-37)__AIY60641.1__M2-1 (opt1)
  source 1..971: mol_type = other RNA
gggagaggcgctgcctacggaggtggcagccatctccttctcggcatcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21298 - RNA, 971 nt, synthetic construct
  misc_feature 1..971: note = mRNA product Design i-2 comprising derived and/or modified sequence from HRSV(Memphis-37)__AIY60641.1__M2-1 (opt2)
  source 1..971: mol_type = other RNA
gggagaggcgctgcctacggaggtggcagccatctccttctcggcatcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21299 - RNA, 971 nt, synthetic construct
  misc_feature 1..971: note = mRNA product Design i-2 comprising derived and/or modified sequence from HRSV(Memphis-37)__AIY60641.1__M2-1 (opt3)
  source 1..971: mol_type = other RNA
gggagaggcgctgcctacggaggtggcagccatctccttctcggcatcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21300 - RNA, 971 nt, synthetic construct
  misc_feature 1..971: note = mRNA product Design i-2 comprising derived and/or modified sequence from HRSV(Memphis-37)__AIY60641.1__M2-1 (opt4)
  source 1..971: mol_type = other RNA
gggagaggcgctgcctacggaggtggcagccatctccttctcggcatcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21301 - RNA, 971 nt, synthetic construct
  misc_feature 1..971: note = mRNA product Design i-2 comprising derived and/or modified sequence from HRSV(Memphis-37)__AIY60641.1__M2-1 (opt5)
  source 1..971: mol_type = other RNA
gggagaggcgctgcctacggaggtggcagccatctccttctcggcatcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21302 - RNA, 971 nt, synthetic construct
  misc_feature 1..971: note = mRNA product Design i-2 comprising derived and/or modified sequence from HRSV(Memphis-37)__AIY60641.1__M2-1 (opt6)
  source 1..971: mol_type = other RNA
gggagaggcgctgcctacggaggtggcagccatctccttctcggcatcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21303 - RNA, 971 nt, synthetic construct
  misc_feature 1..971: note = mRNA product Design i-2 comprising derived and/or modified sequence from HRSV(Memphis-37)__AIY60641.1__M2-1 (opt11)
  source 1..971: mol_type = other RNA
gggagaggcgctgcctacggaggtggcagccatctccttctcggcatcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21304 - RNA, 967 nt, synthetic construct
  misc_feature 1..967: note = mRNA product Design i-2 comprising derived and/or modified sequence from HRSV(Memphis-37)__AIY60641.1__M2-1 (wt)
  source 1..967: mol_type = other RNA
ggggcgctgcctacggaggtggcagccatctccttctcggcatcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21305 - RNA, 967 nt, synthetic construct
  misc_feature 1..967: note = mRNA product Design i-2 comprising derived and/or modified sequence from HRSV(Memphis-37)__AIY60641.1__M2-1 (opt1)
  source 1..967: mol_type = other RNA
ggggcgctgcctacggaggtggcagccatctccttctcggcatcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21306 - RNA, 967 nt, synthetic construct
  misc_feature 1..967: note = mRNA product Design i-2 comprising derived and/or modified sequence from HRSV(Memphis-37)__AIY60641.1__M2-1 (opt2)
  source 1..967: mol_type = other RNA
ggggcgctgcctacggaggtggcagccatctccttctcggcatcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21307 - RNA, 967 nt, synthetic construct
  misc_feature 1..967: note = mRNA product Design i-2 comprising derived and/or modified sequence from HRSV(Memphis-37)__AIY60641.1__M2-1 (opt3)
  source 1..967: mol_type = other RNA
ggggcgctgcctacggaggtggcagccatctccttctcggcatcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21308 - RNA, 967 nt, synthetic construct
  misc_feature 1..967: note = mRNA product Design i-2 comprising derived and/or modified sequence from HRSV(Memphis-37)__AIY60641.1__M2-1 (opt4)
  source 1..967: mol_type = other RNA
ggggcgctgcctacggaggtggcagccatctccttctcggcatcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21309 - RNA, 967 nt, synthetic construct
  misc_feature 1..967: note = mRNA product Design i-2 comprising derived and/or modified sequence from HRSV(Memphis-37)__AIY60641.1__M2-1 (opt5)
  source 1..967: mol_type = other RNA
ggggcgctgcctacggaggtggcagccatctccttctcggcatcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21310 - RNA, 967 nt, synthetic construct
  misc_feature 1..967: note = mRNA product Design i-2 comprising derived and/or modified sequence from HRSV(Memphis-37)__AIY60641.1__M2-1 (opt6)
  source 1..967: mol_type = other RNA
ggggcgctgcctacggaggtggcagccatctccttctcggcatcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21311 - RNA, 967 nt, synthetic construct
  misc_feature 1..967: note = mRNA product Design i-2 comprising derived and/or modified sequence from HRSV(Memphis-37)__AIY60641.1__M2-1 (opt11)
  source 1..967: mol_type = other RNA
ggggcgctgcctacggaggtggcagccatctccttctcggcatcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21312 - RNA, 802 nt, synthetic construct
  misc_feature 1..802: note = mRNA product Design i-3 comprising derived and/or modified sequence from HRSV(Memphis-37)__AIY60641.1__M2-1 (wt)
  source 1..802: mol_type = other RNA
gggagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21313 - RNA, 802 nt, synthetic construct
  misc_feature 1..802: note = mRNA product Design i-3 comprising derived and/or modified sequence from HRSV(Memphis-37)__AIY60641.1__M2-1 (opt1)
  source 1..802: mol_type = other RNA
gggagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21314 - RNA, 802 nt, synthetic construct
  misc_feature 1..802: note = mRNA product Design i-3 comprising derived and/or modified sequence from HRSV(Memphis-37)__AIY60641.1__M2-1 (opt2)
  source 1..802: mol_type = other RNA
gggagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21315 - RNA, 802 nt, synthetic construct
  misc_feature 1..802: note = mRNA product Design i-3 comprising derived and/or modified sequence from HRSV(Memphis-37)__AIY60641.1__M2-1 (opt3)
  source 1..802: mol_type = other RNA
gggagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21316 - RNA, 802 nt, synthetic construct
  misc_feature 1..802: note = mRNA product Design i-3 comprising derived and/or modified sequence from HRSV(Memphis-37)__AIY60641.1__M2-1 (opt4)
  source 1..802: mol_type = other RNA
gggagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21317 - RNA, 802 nt, synthetic construct
  misc_feature 1..802: note = mRNA product Design i-3 comprising derived and/or modified sequence from HRSV(Memphis-37)__AIY60641.1__M2-1 (opt5)
  source 1..802: mol_type = other RNA
gggagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21318 - RNA, 802 nt, synthetic construct
  misc_feature 1..802: note = mRNA product Design i-3 comprising derived and/or modified sequence from HRSV(Memphis-37)__AIY60641.1__M2-1 (opt6)
  source 1..802: mol_type = other RNA
gggagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21319 - RNA, 802 nt, synthetic construct
  misc_feature 1..802: note = mRNA product Design i-3 comprising derived and/or modified sequence from HRSV(Memphis-37)__AIY60641.1__M2-1 (opt11)
  source 1..802: mol_type = other RNA
gggagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21320 - protein, 18 aa, synthetic construct
  REGION 1..18: note = derived and/or modified protein sequence (artificial) from Artificial__carrier peptide 5
CGHHHHHRRRRHHHHHGC

SEQ ID NO: 21321 - skipped

SEQ ID NO: 21322 - RNA, 134 nt, synthetic construct
  misc_feature 1..134: note = mRNA 3'-end N6-A64-N5-C30-histoneSL-N5
  source 1..134: mol_type = other RNA
attaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21323 - RNA, 99 nt, synthetic construct
  misc_feature 1..99: note = mRNA 3'-end N6-histoneSL-A64-N5
  source 1..99: mol_type = other RNA
attaatcaaaggctcttttcagagccaccaaaaaaaaaaaaaaaaaaaaaaaaaaaaaaaaaaaaaaaaaaaaaaaaaaaaaaaaaaaaaaaaagaatt

SEQ ID NO: 21324 - RNA, 99 nt, synthetic construct
  misc_feature 1..99: note = mRNA 3'-end N6-histoneSL-A64-N5
  source 1..99: mol_type = other RNA
agatctcaaaggctcttttcagagccaccaaaaaaaaaaaaaaaaaaaaaaaaaaaaaaaaaaaaaaaaaaaaaaaaaaaaaaaaaaaaaaaaagaatt

SEQ ID NO: 21325 - RNA, 110 nt, synthetic construct
  misc_feature 1..110: note = mRNA 3'-end N12-A64-N5-histoneSL-N5
  source 1..110: mol_type = other RNA
attaatagatctaaaaaaaaaaaaaaaaaaaaaaaaaaaaaaaaaaaaaaaaaaaaaaaaaaaaaaaaaaaaaaaatgcatcaaaggctcttttcagagccaccagaatt

SEQ ID NO: 21326 - RNA, 110 nt, synthetic construct; identical to SEQ ID NO: 21325
  misc_feature 1..110: note = mRNA 3'-end N12-A64-N5-histoneSL-N5
  source 1..110: mol_type = other RNA

SEQ ID NO: 21327 - RNA, 130 nt, synthetic construct
  misc_feature 1..130: note = mRNA 3'-end N6-histoneSL-A100
  source 1..130: mol_type = other RNA
attaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21328 - RNA, 130 nt, synthetic construct
  misc_feature 1..130: note = mRNA 3'-end N6-histoneSL-A100
  source 1..130: mol_type = other RNA
agatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21329 - protein, 24 aa, synthetic construct
  REGION 1..24: note = derived and/or modified protein sequence (wt) from Homo sapiens__AAA59606.1__signal peptide_HLA-A2-SP
MAVMAPRTLVLLLSGALALTQTWA

SEQ ID NO: 21330 - protein, 22 aa, synthetic construct
  REGION 1..22: note = derived and/or modified protein sequence (wt) from Homo sapiens__AAA61213.1__signal peptide_HsPLAT
MDAMKRGLCCVLLLCGAVFVSP

SEQ ID NO: 21331 - protein, 27 aa, synthetic construct
  REGION 1..27: note = derived and/or modified protein sequence (wt) from Homo sapiens__NP_000790.2__signal peptide_HsEPO
MGVHECPAWLWLLLSLLSLPLGLPVLG

SEQ ID NO: 21332 - protein, 18 aa, synthetic construct
  REGION 1..18: note = derived and/or modified protein sequence (wt) from Homo sapiens__NP_000468.1__signal peptide_HsALB
MKWVTFISLLFLFSSAYS

SEQ ID NO: 21333 - protein, 18 aa, synthetic construct
  REGION 1..18: note = derived and/or modified protein sequence (wt) from Homo sapiens__AAB59424.1__signal peptide_IgE
MDWTWILFLVAAATRVHS

SEQ ID NO: 21334 - protein, 24 aa, synthetic construct
  REGION 1..24: note = derived and/or modified protein sequence (wt) from Homo sapiens__NP_055022.2__signal peptide_HsCD5
MPMGSLQPLATLYLLGMLVASCLG

SEQ ID NO: 21335 - protein, 20 aa, synthetic construct
  REGION 1..20: note = derived and/or modified protein sequence (wt) from Homo sapiens__NP_000577.2__signal peptide_HsIL2
MYRMQLLSCIALSLALVTNS

SEQ ID NO: 21336 - protein, 18 aa, synthetic construct
  REGION 1..18: note = derived and/or modified protein sequence (wt) from Homo sapiens__NP_001020371.3 __signal peptide_HsCTRB2
MAFLWLLSCWALLGTTFG

SEQ ID NO: 21337 - protein, 19 aa, synthetic construct
  REGION 1..19: note = derived and/or modified protein sequence (wt) from Homo sapiens__BAC87457.1__signal peptide_IgG-HC
MEFGLSWVFLVALFRGVQC

SEQ ID NO: 21338 - protein, 19 aa, synthetic construct
  REGION 1..19: note = derived and/or modified protein sequence (wt) from Homo sapiens__AAA52897.1__signal peptide_Ig-HC
MDWTWRVFCLLAVTPGAHP

SEQ ID NO: 21339 - protein, 19 aa, synthetic construct
  REGION 1..19: note = derived and/or modified protein sequence (wt) from Homo sapiens__AAA59018.1__signal peptide_Ig-LC
MAWSPLFLTLITHCAGSWA

SEQ ID NO: 21340 - protein, 17 aa, synthetic construct
  REGION 1..17: note = derived and/or modified protein sequence (wt) from Gaussia princeps__AAG54095.1__signal peptide_GpLuc
MGVKVLFALICIAVAEA

SEQ ID NO: 21341 - protein, 21 aa, synthetic construct
  REGION 1..21: note = derived and/or modified protein sequence (wt) from Mus musculus__BAR42292.1__signal peptide_MmIgkappa
METDTLLLWVLLLWVPGSTGD

SEQ ID NO: 21342 - protein, 26 aa, synthetic construct
  REGION 1..26: note = derived and/or modified protein sequence (wt) from Nepenthes rafflesiana__ABF74624.1__signal peptide_NrChit1
MKTHYSSAILPILTLFVFLSINPSHG

SEQ ID NO: 21343 - protein, 21 aa, synthetic construct
  REGION 1..21: note = derived and/or modified protein sequence (wt) from Conus leopardus__AAS93426.1__signal peptide_ClLp1.3
MGMRMMFIMFMLVVLATTVVS

SEQ ID NO: 21344 - protein, 24 aa, synthetic construct
  REGION 1..24: note = derived and/or modified protein sequence (wt) from Nepenthes gracilis__AB114914.1__signal peptide_NgNep1
MASSLYSFLLALSIVYIFVAPTHS

SEQ ID NO: 21345 - protein, 19 aa, synthetic construct
  REGION 1..19: note = derived and/or modified protein sequence (wt) from Homo sapiens__NP_001691.1__signal peptide_HsAzu1
MTRLTVLALLAGLLASSRA

SEQ ID NO: 21346 - protein, 16 aa, synthetic construct
  REGION 1..16: note = derived and/or modified protein sequence (wt) from Homo sapiens__AAA51948.1__signal peptide_HsCD33
MPLLLLLPLLWAGALA

SEQ ID NO: 21347 - protein, 19 aa, synthetic construct
  REGION 1..19: note = derived and/or modified protein sequence (wt) from Vibrio cholerae__BAA06291.1__signal peptide_VcCtxB
MIKLKFGVFFTVLLSSAYA

SEQ ID NO: 21348 - protein, 20 aa, synthetic construct
  REGION 1..20: note = derived and/or modified protein sequence (wt) from Homo sapiens__NP_001890.1__signal peptide_HsCST4
MARPLCTLLLLMATLAGALA

SEQ ID NO: 21349 - protein, 24 aa, synthetic construct
  REGION 1..24: note = derived and/or modified protein sequence (wt) from Homo sapiens__AAA59172.1__signal peptide_HsIns-iso1
MALWMRLLPLLALLALWGPDPAAA

SEQ ID NO: 21350 - protein, 17 aa, synthetic construct
  REGION 1..17: note = derived and/or modified protein sequence (wt) from Homo sapiens__CAA68724.1__signal peptide_HsSPARC
MRAWIFFLLCLAGRALA

SEQ ID NO: 21351 - protein, 17 aa, synthetic construct
  REGION 1..17: note = derived and/or modified protein sequence (wt) from Inluenza A__ACQ45338.1__signal peptide_H1N1(Netherlands2009)-HA
MKAILVVLLYTFATANA

SEQ ID NO: 21352 - protein, 30 aa, synthetic construct
  REGION 1..30: note = derived and/or modified protein sequence (wt) from Yellow fever virus__NP_041726.1__signal peptide_YFV
MRGLSSRKRRSHDVLTVQFLILGMLLMTGG

SEQ ID NO: 21353 - protein, 25 aa, synthetic construct
  REGION 1..25: note = derived and/or modified protein sequence (wt) from Homo sapiens__CAA23783.1__signal peptide_MHCII
MAISGVPVLGFFIIAVLMSAQESWA

SEQ ID NO: 21354 - protein, 24 aa, synthetic construct
  REGION 1..24: note = derived and/or modified protein sequence (wt) from Japanese Encephalitis virus__AOT85928.1__signal peptide_JEV
MGKRSAGSIMWLASLAVVIACAGA

SEQ ID NO: 21355 - protein, 30 aa, synthetic construct
  REGION 1..30: note = derived and/or modified protein sequence (wt) from Japanese Encephalitis virus__AOT85928.1__signal peptide_JEV
MGRKQNKRGGNEGSIMWLASLAVVIACAGA

SEQ ID NO: 21356 - protein, 21 aa, synthetic construct
  REGION 1..21: note = derived and/or modified protein sequence (wt) from Japanese Encephalitis virus__AOT85928.1__signal peptide_JEV
MNEGSIMWLASLAVVIACAGA

SEQ ID NO: 21357 - protein, 24 aa, synthetic construct
  REGION 1..24: note = derived and/or modified protein sequence (wt) from Japanese encephalitis virus__BAE48356.1__signal peptide_JEV-prM
MLGSNSGQRVVFTILLLLVAPAYS

SEQ ID NO: 21358 - protein, 15 aa, synthetic construct
  REGION 1..15: note = derived and/or modified protein sequence (wt) from Japanese encephalitis virus__ADN94470.1__signal peptide_JEV-ER
MWLVSLAIVTACAGA

SEQ ID NO: 21359 - protein, 17 aa, synthetic construct
  REGION 1..17: note = derived and/or modified protein sequence (wt) from Vesicular stomatitis Indiana virus__NP_041715.1 __signal peptide_VSIV-G
MKCLLYLAFLFIGVNCK

SEQ ID NO: 21360 - protein, 17 aa, synthetic construct
  REGION 1..17: note = derived and/or modified protein sequence (wt) from Vesicular stomatitis Indiana virus__NP_041715.1 __signal peptide_VSIV-G(K17A)
MKCLLYLAFLFIGVNCA

SEQ ID NO: 21361 - protein, 20 aa, synthetic construct
  REGION 1..20: note = derived and/or modified protein sequence (wt) from Homo sapiens__AAH62704.1__signal peptide_HsIGK@
METPAQLLFLLLLWLPDTTG

SEQ ID NO: 21362 - protein, 20 aa, synthetic construct
  REGION 1..20: note = derived and/or modified protein sequence (wt) from Homo sapiens__NP_000575.1__signal peptide_HsCXCL8
MTSKLAVALLAAFLISAALC

SEQ ID NO: 21363 - RNA, 1725 nt, synthetic construct
  misc_feature 1..1725: note = derived and/or modified CDS sequence (opt1) from HRSV(A2)__F0
  source 1..1725: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctgctccacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactga

SEQ ID NO: 21364 - RNA, 1662 nt, synthetic construct
  misc_feature 1..1662: note = derived and/or modified CDS sequence (opt1) from HRSV(A2)__F-del
  source 1..1662: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctgctccacaacgtgaacgccggcaagagcacgaccaacatcatgatcaccaccatcatcatcgtgatcatcgtcatcctgctgtccctcatcgccgtggggctgctgctctactgcaaggcgcgctga

SEQ ID NO: 21365 - RNA, 1725 nt, synthetic construct
  misc_feature 1..1725: note = derived and/or modified CDS sequence (opt1) from HRSV(A2)__F0_DSCav1
  source 1..1725: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctggccttcatccggaagtccgacgagctcctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactga

SEQ ID NO: 21366 - RNA, 1662 nt, synthetic construct
  misc_feature 1..1662: note = derived and/or modified CDS sequence (opt1) from HRSV(A2)__F-del_DSCav1
  source 1..1662: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctggccttcatccggaagtccgacgagctcctgcacaacgtcaacgccggcaagtccacgaccaacatcatgatcaccaccatcatcatcgtgatcatcgtgatcctgctcagcctgatcgccgtcgggctgctcctgtactgcaaggcgcgctga

SEQ ID NO: 21367 - RNA, 1608 nt, synthetic construct
  misc_feature 1..1608: note = derived and/or modified CDS sequence (opt1) from HRSV(A2)__F_DSCav1_mut0
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactga

SEQ ID NO: 21368 - RNA, 1545 nt, synthetic construct
  misc_feature 1..1545: note = derived and/or modified CDS sequence (opt1) from HRSV(A2)__F-del_DSCav1_mut0
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctga

SEQ ID NO: 21369 - RNA, 1608 nt, synthetic construct
  misc_feature 1..1608: note = derived and/or modified CDS sequence (opt1) from HRSV(A2)__F_DSCav1_mut1
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactga

SEQ ID NO: 21370 - RNA, 1545 nt, synthetic construct
  misc_feature 1..1545: note = derived and/or modified CDS sequence (opt1) from HRSV(A2)__F-del_DSCav1_mut1
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtga

SEQ ID NO: 21371 - RNA, 1608 nt, synthetic construct
  misc_feature 1..1608: note = derived and/or modified CDS sequence (opt1) from HRSV(A2)__F_DSCav1_mut2
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactga

SEQ ID NO: 21372 - RNA, 1545 nt, synthetic construct
  misc_feature 1..1545: note = derived and/or modified CDS sequence (opt1) from HRSV(A2)__F-del_DSCav1_mut2
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtga

SEQ ID NO: 21373 - RNA, 1608 nt, synthetic construct
  misc_feature 1..1608: note = derived and/or modified CDS sequence (opt1) from HRSV(A2)__F_DSCav1_mut3
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactga

SEQ ID NO: 21374 - RNA, 1545 nt, synthetic construct
  misc_feature 1..1545: note = derived and/or modified CDS sequence (opt1) from HRSV(A2)__F-del_DSCav1_mut3
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtga

SEQ ID NO: 21375 - RNA, 1608 nt, synthetic construct
  misc_feature 1..1608: note = derived and/or modified CDS sequence (opt1) from HRSV(A2)__F_DSCav1_mut4
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgccggctccgtgagcttcttcccccaggcggagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactgcgtcaacaagcaggaggggaagtccctctacgtgaagggcgagcccatcatcaacttctacgaccccctggtgttccccagcgacgagttcgacgcctccatcagccaggtcaacgagaagatcaaccagtccctggccttcatccggaagtccgacgagctcctgcacaacgtgaacgcggggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactga

SEQ ID NO: 21376 - RNA, 1545 nt, synthetic construct
  misc_feature 1..1545: note = derived and/or modified CDS sequence (opt1) from HRSV(A2)__F-del_DSCav1_mut4
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgccggctccgtgagcttcttcccccaggcggagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactgcgtcaacaagcaggaggggaagtccctctacgtgaagggcgagcccatcatcaacttctacgaccccctggtgttccccagcgacgagttcgacgcctccatcagccaggtcaacgagaagatcaaccagtccctggccttcatccggaagtccgacgagctcctgcacaacgtgaacgcggggaagtccaccaccaacatcatgatcaccacgatcatcatcgtgatcatcgtcatcctgctcagcctgatcgccgtgggcctgctgctctactgcaaggcccgctga

SEQ ID NO: 21377 - RNA, 1611 nt, synthetic construct
  misc_feature 1..1611: note = derived and/or modified CDS sequence (opt1) from HRSV(A2)__F_DSCav1_mut5
  source 1..1611: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggagcaacatctgcctgacccgcaccgaccggggctggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgcgggatcatcaagaccttctccaacggctgcgactacgtgagcaacaagggcgtcgacacggtgagcgtggggaacaccctgtactacgtcaacaagcaggagggcaagtccctctacgtgaagggggagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctccaccccggtgaccctgagcaaggaccagctgtccggcatcaacaacatcgccttcagcaactga

SEQ ID NO: 21378 - RNA, 1548 nt, synthetic construct
  misc_feature 1..1548: note = derived and/or modified CDS sequence (opt1) from HRSV(A2)__F-del_DSCav1_mut5
  source 1..1548: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggagcaacatctgcctgacccgcaccgaccggggctggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgcgggatcatcaagaccttctccaacggctgcgactacgtgagcaacaagggcgtcgacacggtgagcgtggggaacaccctgtactacgtcaacaagcaggagggcaagtccctctacgtgaagggggagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctga

SEQ ID NO: 21379 - RNA, 1608 nt, synthetic construct
  misc_feature 1..1608: note = derived and/or modified CDS sequence (opt1) from HRSV(A2)__F_DSCav1_mut6
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctccacccccgtgaccctgagcaaggaccagctgtccggcatcaacaacatcgccttcagcaactga

SEQ ID NO: 21380 - RNA, 1545 nt, synthetic construct
  misc_feature 1..1545: note = derived and/or modified CDS sequence (opt1) from HRSV(A2)__F-del_DSCav1_mut6
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctga

SEQ ID NO: 21381 - RNA, 1608 nt, synthetic construct
  misc_feature 1..1608: note = derived and/or modified CDS sequence (opt1) from HRSV(A2)__F_DSCav1_mut7
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactga

SEQ ID NO: 21382 - RNA, 1545 nt, synthetic construct
  misc_feature 1..1545: note = derived and/or modified CDS sequence (opt1) from HRSV(A2)__F-del_DSCav1_mut7
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctga

SEQ ID NO: 21383 - RNA, 1611 nt, synthetic construct
  misc_feature 1..1611: note = derived and/or modified CDS sequence (opt1) from HRSV(A2)__F_DSCav1_mut8
  source 1..1611: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctgctcctgtactgcaaggcccggtccacccccgtgaccctgagcaaggaccagctctccggcatcaacaacatcgccttcagcaactga

SEQ ID NO: 21384 - RNA, 1548 nt, synthetic construct
  misc_feature 1..1548: note = derived and/or modified CDS sequence (opt1) from HRSV(A2)__F-del_DSCav1_mut8
  source 1..1548: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctgctcctgtactgcaaggcccggtga

SEQ ID NO: 21385 - RNA, 771 nt, synthetic construct; identical to SEQ ID NO: 9686
  misc_feature 1..771: note = derived and/or modified CDS sequence (opt1) from HRSV(A2)__P0DOE7.1__M
  source 1..771: mol_type = other RNA

SEQ ID NO: 21386 - RNA, 1176 nt, synthetic construct; identical to SEQ ID NO: 10136
  misc_feature 1..1176: note = derived and/or modified CDS sequence (opt1) from HRSV(A2)__P03418.1__N
  source 1..1176: mol_type = other RNA

SEQ ID NO: 21387 - RNA, 726 nt, synthetic construct; identical to SEQ ID NO: 10639
  misc_feature 1..726: note = derived and/or modified CDS sequence (opt1) from HRSV(A2)__P03421.1__P
  source 1..726: mol_type = other RNA

SEQ ID NO: 21388 - RNA, 585 nt, synthetic construct; identical to SEQ ID NO: 11185
  misc_feature 1..585: note = derived and/or modified CDS sequence (opt1) from HRSV(A2)__P04545.1__M2-1
  source 1..585: mol_type = other RNA

SEQ ID NO: 21389 - RNA, 1725 nt, synthetic construct
  misc_feature 1..1725: note = derived and/or modified CDS sequence (opt1) from HRSV(Memphis-37)__AIY60640.1__F0
  source 1..1725: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctgctccacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 21390 - RNA, 1662 nt, synthetic construct
  misc_feature 1..1662: note = derived and/or modified CDS sequence (opt1) from HRSV(Memphis-37)__AIY60640.1__F-del
  source 1..1662: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctgctccacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 21391 - RNA, 1725 nt, synthetic construct
  misc_feature 1..1725: note = derived and/or modified CDS sequence (opt1) from HRSV(Memphis-37)__AIY60640.1__F0_DSCav1
  source 1..1725: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctggccttcatccggaagtccgacgagctcctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactga

SEQ ID NO: 21392 - RNA, 1662 nt, synthetic construct
  misc_feature 1..1662: note = derived and/or modified CDS sequence (opt1) from HRSV(Memphis-37)__AIY60640.1__F-del_DSCav1
  source 1..1662: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctggccttcatccggaagtccgacgagctcctgcacaacgtgaacgtggggaagtccaccacgaacatcatgatcaccaccatcatcatcgtcatcatcgtgatcctgctcctgctgatcgccgtgggcctcttcctgtactgcaaggcccgctga

SEQ ID NO: 21393 - RNA, 1608 nt, synthetic construct
  misc_feature 1..1608: note = derived and/or modified CDS sequence (opt1) from HRSV(Memphis-37)__AIY60640.1__F_DSCav1_mut0
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactga

SEQ ID NO: 21394 - RNA, 1545 nt, synthetic construct
  misc_feature 1..1545: note = derived and/or modified CDS sequence (opt1) from HRSV(Memphis-37)__AIY60640.1__F-del_DSCav1_mut0
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctga

SEQ ID NO: 21395 - RNA, 1608 nt, synthetic construct
  misc_feature 1..1608: note = derived and/or modified CDS sequence (opt1) from HRSV(Memphis-37)__AIY60640.1__F_DSCav1_mut1
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactga

SEQ ID NO: 21396 - RNA, 1545 nt, synthetic construct
  misc_feature 1..1545: note = derived and/or modified CDS sequence (opt1) from HRSV(Memphis-37)__AIY60640.1__F-del_DSCav1_mut1
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtga

SEQ ID NO: 21397 - RNA, 1608 nt, synthetic construct
  misc_feature 1..1608: note = derived and/or modified CDS sequence (opt1) from HRSV(Memphis-37)__AIY60640.1__F_DSCav1_mut2
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactga

SEQ ID NO: 21398 - RNA, 1545 nt, synthetic construct
  misc_feature 1..1545: note = derived and/or modified CDS sequence (opt1) from HRSV(Memphis-37)__AIY60640.1__F-del_DSCav1_mut2
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtga

SEQ ID NO: 21399 - RNA, 1608 nt, synthetic construct
  misc_feature 1..1608: note = derived and/or modified CDS sequence (opt1) from HRSV(Memphis-37)__AIY60640.1__F_DSCav1_mut3
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactga

SEQ ID NO: 21400 - RNA, 1545 nt, synthetic construct
  misc_feature 1..1545: note = derived and/or modified CDS sequence (opt1) from HRSV(Memphis-37)__AIY60640.1__F-del_DSCav1_mut3
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtga

SEQ ID NO: 21401 - RNA, 1608 nt, synthetic construct
  misc_feature 1..1608: note = derived and/or modified CDS sequence (opt1) from HRSV(Memphis-37)__AIY60640.1__F_DSCav1_mut4
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactgcgtgaacaagcaggagggcaagtccctctacgtgaagggggagcccatcatcaacttctacgaccccctggtcttcccgagcgacgagttcgacgcctccatcagccaggtgaacgagaagatcaaccagtccctggcgttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactga

SEQ ID NO: 21402 - RNA, 1545 nt, synthetic construct
  misc_feature 1..1545: note = derived and/or modified CDS sequence (opt1) from HRSV(Memphis-37)__AIY60640.1__F-del_DSCav1_mut4
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactgcgtgaacaagcaggagggcaagtccctctacgtgaagggggagcccatcatcaacttctacgaccccctggtcttcccgagcgacgagttcgacgcctccatcagccaggtgaacgagaagatcaaccagtccctggcgttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctga

SEQ ID NO: 21403 - RNA, 1611 nt, synthetic construct
  misc_feature 1..1611: note = derived and/or modified CDS sequence (opt1) from HRSV(Memphis-37)__AIY60640.1__F_DSCav1_mut5
  source 1..1611: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggcagcaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccgcggcatcatcaagaccttctccaacgggtgcgactacgtcagcaacaagggcgtggacaccgtgagcgtcggcaacacgctgtactacgtgaacaagcaggaggggaagtccctctacgtgaagggcgagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccgcagcacgcccgtgaccctgtccaaggaccagctgagcgggatcaacaacatcgccttctccaactga

SEQ ID NO: 21404 - RNA, 1548 nt, synthetic construct
  misc_feature 1..1548: note = derived and/or modified CDS sequence (opt1) from HRSV(Memphis-37)__AIY60640.1__F-del_DSCav1_mut5
  source 1..1548: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggcagcaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccgcggcatcatcaagaccttctccaacgggtgcgactacgtcagcaacaagggcgtggacaccgtgagcgtcggcaacacgctgtactacgtgaacaagcaggaggggaagtccctctacgtgaagggcgagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccgctga

SEQ ID NO: 21405 - RNA, 1608 nt, synthetic construct
  misc_feature 1..1608: note = derived and/or modified CDS sequence (opt1) from HRSV(Memphis-37)__AIY60640.1__F_DSCav1_mut6
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccggagcacgcccgtgaccctgtccaaggaccagctgagcgggatcaacaacatcgccttctccaactga

SEQ ID NO: 21406 - RNA, 1545 nt, synthetic construct
  misc_feature 1..1545: note = derived and/or modified CDS sequence (opt1) from HRSV(Memphis-37)__AIY60640.1__F-del_DSCav1_mut6
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccggtga

SEQ ID NO: 21407 - RNA, 1608 nt, synthetic construct
  misc_feature 1..1608: note = derived and/or modified CDS sequence (opt1) from HRSV(Memphis-37)__AIY60640.1__F_DSCav1_mut7
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactga

SEQ ID NO: 21408 - RNA, 1545 nt, synthetic construct
  misc_feature 1..1545: note = derived and/or modified CDS sequence (opt1) from HRSV(Memphis-37)__AIY60640.1__F-del_DSCav1_mut7
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctga

SEQ ID NO: 21409 - RNA, 1611 nt, synthetic construct
  misc_feature 1..1611: note = derived and/or modified CDS sequence (opt1) from HRSV(Memphis-37)__AIY60640.1__F_DSCav1_mut8
  source 1..1611: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactga

SEQ ID NO: 21410 - RNA, 1548 nt, synthetic construct
  misc_feature 1..1548: note = derived and/or modified CDS sequence (opt1) from HRSV(Memphis-37)__AIY60640.1__F-del_DSCav1_mut8
  source 1..1548: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaaggggtacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctgatcgccgtcggcctcttcctgtactgcaaggcccggtga

SEQ ID NO: 21411 - RNA, 771 nt, synthetic construct; identical to SEQ ID NO: 9686
  misc_feature 1..771: note = derived and/or modified CDS sequence (opt1) from HRSV(Memphis-37)__AIY60638.1__M
  source 1..771: mol_type = other RNA

SEQ ID NO: 21412 - RNA, 1176 nt, synthetic construct; identical to SEQ ID NO: 20215
  misc_feature 1..1176: note = derived and/or modified CDS sequence (opt1) from HRSV(Memphis-37)__AIY60635.1__N
  source 1..1176: mol_type = other RNA

SEQ ID NO: 21413 - RNA, 726 nt, synthetic construct; identical to SEQ ID NO: 20584
  misc_feature 1..726: note = derived and/or modified CDS sequence (opt1) from HRSV(Memphis-37)__AIY60637.1__P
  source 1..726: mol_type = other RNA

SEQ ID NO: 21414 - RNA, 585 nt, synthetic construct; identical to SEQ ID NO: 20953
  misc_feature 1..585: note = derived and/or modified CDS sequence (opt1) from HRSV(Memphis-37)__AIY60641.1__M2-1
  source 1..585: mol_type = other RNA

SEQ ID NO: 21415 - RNA, 1997 nt, synthetic construct
  misc_feature 1..1997: note = mRNA product Design a-1 (hSL-A100) comprising derived and/or modified sequence from HRSV(A2)__F0 (opt1)
  source 1..1997: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21416 - RNA, 1997 nt, synthetic construct
  misc_feature 1..1997: note = mRNA product Design a-1 (hSL-A100) comprising derived and/or modified sequence from HRSV(A2)__F0 (opt1)
  source 1..1997: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21417 - RNA, 1997 nt, synthetic construct
  misc_feature 1..1997: note = mRNA product Design a-1 (hSL-A100) comprising derived and/or modified sequence from HRSV(A2)__F0 (opt1)
  source 1..1997: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctgctccacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21418 - RNA, 1934 nt, synthetic construct
  misc_feature 1..1934: note = mRNA product Design a-1 (hSL-A100) comprising derived and/or modified sequence from HRSV(A2)__F-del (opt1)
  source 1..1934: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21419 - RNA, 1934 nt, synthetic construct
  misc_feature 1..1934: note = mRNA product Design a-1 (hSL-A100) comprising derived and/or modified sequence from HRSV(A2)__F-del (opt1)
  source 1..1934: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21420 - RNA, 1934 nt, synthetic construct
  misc_feature 1..1934: note = mRNA product Design a-1 (hSL-A100) comprising derived and/or modified sequence from HRSV(A2)__F-del (opt1)
  source 1..1934: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctgctccacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21421 - RNA, 1997 nt, synthetic construct
  misc_feature 1..1997: note = mRNA product Design a-1 (hSL-A100) comprising derived and/or modified sequence from HRSV(A2)__F0_DSCav1 (opt1)
  source 1..1997: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21422 - RNA, 1997 nt, synthetic construct
  misc_feature 1..1997: note = mRNA product Design a-1 (hSL-A100) comprising derived and/or modified sequence from HRSV(A2)__F0_DSCav1 (opt1)
  source 1..1997: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21423 - RNA, 1997 nt, synthetic construct
  misc_feature 1..1997: note = mRNA product Design a-1 (hSL-A100) comprising derived and/or modified sequence from HRSV(A2)__F0_DSCav1 (opt1)
  source 1..1997: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctggccttcatccggaagtccgacgagctcctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21424 - RNA, 1934 nt, synthetic construct
  misc_feature 1..1934: note = mRNA product Design a-1 (hSL-A100) comprising derived and/or modified sequence from HRSV(A2)__F-del_DSCav1 (opt1)
  source 1..1934: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21425 - RNA, 1934 nt, synthetic construct
  misc_feature 1..1934: note = mRNA product Design a-1 (hSL-A100) comprising derived and/or modified sequence from HRSV(A2)__F-del_DSCav1 (opt1)
  source 1..1934: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21426 - RNA, 1934 nt, synthetic construct
  misc_feature 1..1934: note = mRNA product Design a-1 (hSL-A100) comprising derived and/or modified sequence from HRSV(A2)__F-del_DSCav1 (opt1)
  source 1..1934: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctggccttcatccggaagtccgacgagctcctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21427 - RNA, 1880 nt, synthetic construct
  misc_feature 1..1880: note = mRNA product Design a-1 (hSL-A100) comprising derived and/or modified sequence from HRSV(A2)__F_DSCav1_mut0 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21428 - RNA, 1880 nt, synthetic construct
  misc_feature 1..1880: note = mRNA product Design a-1 (hSL-A100) comprising derived and/or modified sequence from HRSV(A2)__F_DSCav1_mut0 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21429 - RNA, 1880 nt, synthetic construct
  misc_feature 1..1880: note = mRNA product Design a-1 (hSL-A100) comprising derived and/or modified sequence from HRSV(A2)__F_DSCav1_mut0 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21430 - RNA, 1817 nt, synthetic construct
  misc_feature 1..1817: note = mRNA product Design a-1 (hSL-A100) comprising derived and/or modified sequence from HRSV(A2)__F-del_DSCav1_mut0 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21431 - RNA, 1817 nt, synthetic construct
  misc_feature 1..1817: note = mRNA product Design a-1 (hSL-A100) comprising derived and/or modified sequence from HRSV(A2)__F-del_DSCav1_mut0 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21432 - RNA, 1817 nt, synthetic construct
  misc_feature 1..1817: note = mRNA product Design a-1 (hSL-A100) comprising derived and/or modified sequence from HRSV(A2)__F-del_DSCav1_mut0 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21433 - RNA, 1880 nt, synthetic construct
  misc_feature 1..1880: note = mRNA product Design a-1 (hSL-A100) comprising derived and/or modified sequence from HRSV(A2)__F_DSCav1_mut1 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21434 - RNA, 1880 nt, synthetic construct
  misc_feature 1..1880: note = mRNA product Design a-1 (hSL-A100) comprising derived and/or modified sequence from HRSV(A2)__F_DSCav1_mut1 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21435 - RNA, 1880 nt, synthetic construct
  misc_feature 1..1880: note = mRNA product Design a-1 (hSL-A100) comprising derived and/or modified sequence from HRSV(A2)__F_DSCav1_mut1 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21436 - RNA, 1817 nt, synthetic construct
  misc_feature 1..1817: note = mRNA product Design a-1 (hSL-A100) comprising derived and/or modified sequence from HRSV(A2)__F-del_DSCav1_mut1 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21437 - RNA, 1817 nt, synthetic construct
  misc_feature 1..1817: note = mRNA product Design a-1 (hSL-A100) comprising derived and/or modified sequence from HRSV(A2)__F-del_DSCav1_mut1 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21438 - RNA, 1817 nt, synthetic construct
  misc_feature 1..1817: note = mRNA product Design a-1 (hSL-A100) comprising derived and/or modified sequence from HRSV(A2)__F-del_DSCav1_mut1 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21439 - RNA, 1880 nt, synthetic construct
  misc_feature 1..1880: note = mRNA product Design a-1 (hSL-A100) comprising derived and/or modified sequence from HRSV(A2)__F_DSCav1_mut2 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21440 - RNA, 1880 nt, synthetic construct
  misc_feature 1..1880: note = mRNA product Design a-1 (hSL-A100) comprising derived and/or modified sequence from HRSV(A2)__F_DSCav1_mut2 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21441 - RNA, 1880 nt, synthetic construct
  misc_feature 1..1880: note = mRNA product Design a-1 (hSL-A100) comprising derived and/or modified sequence from HRSV(A2)__F_DSCav1_mut2 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21442 - RNA, 1817 nt, synthetic construct
  misc_feature 1..1817: note = mRNA product Design a-1 (hSL-A100) comprising derived and/or modified sequence from HRSV(A2)__F-del_DSCav1_mut2 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21443 - RNA, 1817 nt, synthetic construct
  misc_feature 1..1817: note = mRNA product Design a-1 (hSL-A100) comprising derived and/or modified sequence from HRSV(A2)__F-del_DSCav1_mut2 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21444 - RNA, 1817 nt, synthetic construct
  misc_feature 1..1817: note = mRNA product Design a-1 (hSL-A100) comprising derived and/or modified sequence from HRSV(A2)__F-del_DSCav1_mut2 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21445 - RNA, 1880 nt, synthetic construct
  misc_feature 1..1880: note = mRNA product Design a-1 (hSL-A100) comprising derived and/or modified sequence from HRSV(A2)__F_DSCav1_mut3 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21446 - RNA, 1880 nt, synthetic construct
  misc_feature 1..1880: note = mRNA product Design a-1 (hSL-A100) comprising derived and/or modified sequence from HRSV(A2)__F_DSCav1_mut3 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21447 - RNA, 1880 nt, synthetic construct
  misc_feature 1..1880: note = mRNA product Design a-1 (hSL-A100) comprising derived and/or modified sequence from HRSV(A2)__F_DSCav1_mut3 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21448 - RNA, 1817 nt, synthetic construct
  misc_feature 1..1817: note = mRNA product Design a-1 (hSL-A100) comprising derived and/or modified sequence from HRSV(A2)__F-del_DSCav1_mut3 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21449 - RNA, 1817 nt, synthetic construct
  misc_feature 1..1817: note = mRNA product Design a-1 (hSL-A100) comprising derived and/or modified sequence from HRSV(A2)__F-del_DSCav1_mut3 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21450 - RNA, 1817 nt, synthetic construct
  misc_feature 1..1817: note = mRNA product Design a-1 (hSL-A100) comprising derived and/or modified sequence from HRSV(A2)__F-del_DSCav1_mut3 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21451 - RNA, 1880 nt, synthetic construct
  misc_feature 1..1880: note = mRNA product Design a-1 (hSL-A100) comprising derived and/or modified sequence from HRSV(A2)__F_DSCav1_mut4 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21452 - RNA, 1880 nt, synthetic construct
  misc_feature 1..1880: note = mRNA product Design a-1 (hSL-A100) comprising derived and/or modified sequence from HRSV(A2)__F_DSCav1_mut4 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21453 - RNA, 1880 nt, synthetic construct
  misc_feature 1..1880: note = mRNA product Design a-1 (hSL-A100) comprising derived and/or modified sequence from HRSV(A2)__F_DSCav1_mut4 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgccggctccgtgagcttcttcccccaggcggagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactgcgtcaacaagcaggaggggaagtccctctacgtgaagggcgagcccatcatcaacttctacgaccccctggtgttccccagcgacgagttcgacgcctccatcagccaggtcaacgagaagatcaaccagtccctggccttcatccggaagtccgacgagctcctgcacaacgtgaacgcggggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21454 - RNA, 1817 nt, synthetic construct
  misc_feature 1..1817: note = mRNA product Design a-1 (hSL-A100) comprising derived and/or modified sequence from HRSV(A2)__F-del_DSCav1_mut4 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21455 - RNA, 1817 nt, synthetic construct
  misc_feature 1..1817: note = mRNA product Design a-1 (hSL-A100) comprising derived and/or modified sequence from HRSV(A2)__F-del_DSCav1_mut4 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21456 - RNA, 1817 nt, synthetic construct
  misc_feature 1..1817: note = mRNA product Design a-1 (hSL-A100) comprising derived and/or modified sequence from HRSV(A2)__F-del_DSCav1_mut4 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgccggctccgtgagcttcttcccccaggcggagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactgcgtcaacaagcaggaggggaagtccctctacgtgaagggcgagcccatcatcaacttctacgaccccctggtgttccccagcgacgagttcgacgcctccatcagccaggtcaacgagaagatcaaccagtccctggccttcatccggaagtccgacgagctcctgcacaacgtgaacgcggggaagtccaccaccaacatcatgatcaccacgatcatcatcgtgatcatcgtcatcctgctcagcctgatcgccgtgggcctgctgctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21457 - RNA, 1883 nt, synthetic construct
  misc_feature 1..1883: note = mRNA product Design a-1 (hSL-A100) comprising derived and/or modified sequence from HRSV(A2)__F_DSCav1_mut5 (opt1)
  source 1..1883: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21458 - RNA, 1883 nt, synthetic construct
  misc_feature 1..1883: note = mRNA product Design a-1 (hSL-A100) comprising derived and/or modified sequence from HRSV(A2)__F_DSCav1_mut5 (opt1)
  source 1..1883: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21459 - RNA, 1883 nt, synthetic construct
  misc_feature 1..1883: note = mRNA product Design a-1 (hSL-A100) comprising derived and/or modified sequence from HRSV(A2)__F_DSCav1_mut5 (opt1)
  source 1..1883: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggagcaacatctgcctgacccgcaccgaccggggctggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgcgggatcatcaagaccttctccaacggctgcgactacgtgagcaacaagggcgtcgacacggtgagcgtggggaacaccctgtactacgtcaacaagcaggagggcaagtccctctacgtgaagggggagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctccaccccggtgaccctgagcaaggaccagctgtccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21460 - RNA, 1820 nt, synthetic construct
  misc_feature 1..1820: note = mRNA product Design a-1 (hSL-A100) comprising derived and/or modified sequence from HRSV(A2)__F-del_DSCav1_mut5 (opt1)
  source 1..1820: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21461 - RNA, 1820 nt, synthetic construct
  misc_feature 1..1820: note = mRNA product Design a-1 (hSL-A100) comprising derived and/or modified sequence from HRSV(A2)__F-del_DSCav1_mut5 (opt1)
  source 1..1820: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21462 - RNA, 1820 nt, synthetic construct
  misc_feature 1..1820: note = mRNA product Design a-1 (hSL-A100) comprising derived and/or modified sequence from HRSV(A2)__F-del_DSCav1_mut5 (opt1)
  source 1..1820: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggagcaacatctgcctgacccgcaccgaccggggctggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgcgggatcatcaagaccttctccaacggctgcgactacgtgagcaacaagggcgtcgacacggtgagcgtggggaacaccctgtactacgtcaacaagcaggagggcaagtccctctacgtgaagggggagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21463 - RNA, 1880 nt, synthetic construct
  misc_feature 1..1880: note = mRNA product Design a-1 (hSL-A100) comprising derived and/or modified sequence from HRSV(A2)__F_DSCav1_mut6 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21464 - RNA, 1880 nt, synthetic construct
  misc_feature 1..1880: note = mRNA product Design a-1 (hSL-A100) comprising derived and/or modified sequence from HRSV(A2)__F_DSCav1_mut6 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21465 - RNA, 1880 nt, synthetic construct
  misc_feature 1..1880: note = mRNA product Design a-1 (hSL-A100) comprising derived and/or modified sequence from HRSV(A2)__F_DSCav1_mut6 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21466 - RNA, 1817 nt, synthetic construct
  misc_feature 1..1817: note = mRNA product Design a-1 (hSL-A100) comprising derived and/or modified sequence from HRSV(A2)__F-del_DSCav1_mut6 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21467 - RNA, 1817 nt, synthetic construct
  misc_feature 1..1817: note = mRNA product Design a-1 (hSL-A100) comprising derived and/or modified sequence from HRSV(A2)__F-del_DSCav1_mut6 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21468 - RNA, 1817 nt, synthetic construct
  misc_feature 1..1817: note = mRNA product Design a-1 (hSL-A100) comprising derived and/or modified sequence from HRSV(A2)__F-del_DSCav1_mut6 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21469 - RNA, 1880 nt, synthetic construct
  misc_feature 1..1880: note = mRNA product Design a-1 (hSL-A100) comprising derived and/or modified sequence from HRSV(A2)__F_DSCav1_mut7 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21470 - RNA, 1880 nt, synthetic construct
  misc_feature 1..1880: note = mRNA product Design a-1 (hSL-A100) comprising derived and/or modified sequence from HRSV(A2)__F_DSCav1_mut7 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21471 - RNA, 1880 nt, synthetic construct
  misc_feature 1..1880: note = mRNA product Design a-1 (hSL-A100) comprising derived and/or modified sequence from HRSV(A2)__F_DSCav1_mut7 (opt1)
  source 1..1880: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21472 - RNA, 1817 nt, synthetic construct
  misc_feature 1..1817: note = mRNA product Design a-1 (hSL-A100) comprising derived and/or modified sequence from HRSV(A2)__F-del_DSCav1_mut7 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21473 - RNA, 1817 nt, synthetic construct
  misc_feature 1..1817: note = mRNA product Design a-1 (hSL-A100) comprising derived and/or modified sequence from HRSV(A2)__F-del_DSCav1_mut7 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21474 - RNA, 1817 nt, synthetic construct
  misc_feature 1..1817: note = mRNA product Design a-1 (hSL-A100) comprising derived and/or modified sequence from HRSV(A2)__F-del_DSCav1_mut7 (opt1)
  source 1..1817: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21475 - RNA, 1883 nt, synthetic construct
  misc_feature 1..1883: note = mRNA product Design a-1 (hSL-A100) comprising derived and/or modified sequence from HRSV(A2)__F_DSCav1_mut8 (opt1)
  source 1..1883: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21476 - RNA, 1883 nt, synthetic construct
  misc_feature 1..1883: note = mRNA product Design a-1 (hSL-A100) comprising derived and/or modified sequence from HRSV(A2)__F_DSCav1_mut8 (opt1)
  source 1..1883: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21477 - RNA, 1883 nt, synthetic construct
  misc_feature 1..1883: note = mRNA product Design a-1 (hSL-A100) comprising derived and/or modified sequence from HRSV(A2)__F_DSCav1_mut8 (opt1)
  source 1..1883: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctgctcctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21478 - RNA, 1820 nt, synthetic construct
  misc_feature 1..1820: note = mRNA product Design a-1 (hSL-A100) comprising derived and/or modified sequence from HRSV(A2)__F-del_DSCav1_mut8 (opt1)
  source 1..1820: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21479 - RNA, 1820 nt, synthetic construct
  misc_feature 1..1820: note = mRNA product Design a-1 (hSL-A100) comprising derived and/or modified sequence from HRSV(A2)__F-del_DSCav1_mut8 (opt1)
  source 1..1820: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21480 - RNA, 1820 nt, synthetic construct
  misc_feature 1..1820: note = mRNA product Design a-1 (hSL-A100) comprising derived and/or modified sequence from HRSV(A2)__F-del_DSCav1_mut8 (opt1)
  source 1..1820: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctgctcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21481 - RNA, 1043 nt, synthetic construct
  misc_feature 1..1043: note = mRNA product Design a-1 (hSL-A100) comprising derived and/or modified sequence from HRSV(A2)__P0DOE7.1__M (opt1)
  source 1..1043: mol_type = other RNA
aggagagtcccgcagtcggcgtccagcggctctgcttgttcgtgtgtgtgtcgttgcaggccttattcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21482 - RNA, 1043 nt, synthetic construct; identical to SEQ ID NO: 21481
  misc_feature 1..1043: note = mRNA product Design a-1 (hSL-A100) comprising derived and/or modified sequence from HRSV(A2)__P0DOE7.1__M (opt1)
  source 1..1043: mol_type = other RNA

SEQ ID NO: 21483 - RNA, 1448 nt, synthetic construct
  misc_feature 1..1448: note = mRNA product Design a-1 (hSL-A100) comprising derived and/or modified sequence from HRSV(A2)__P03418.1__N (opt1)
  source 1..1448: mol_type = other RNA
aggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21484 - RNA, 1448 nt, synthetic construct; identical to SEQ ID NO: 21483
  misc_feature 1..1448: note = mRNA product Design a-1 (hSL-A100) comprising derived and/or modified sequence from HRSV(A2)__P03418.1__N (opt1)
  source 1..1448: mol_type = other RNA

SEQ ID NO: 21485 - RNA, 998 nt, synthetic construct
  misc_feature 1..998: note = mRNA product Design a-1 (hSL-A100) comprising derived and/or modified sequence from HRSV(A2)__P03421.1__P (opt1)
  source 1..998: mol_type = other RNA
aggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21486 - RNA, 998 nt, synthetic construct; identical to SEQ ID NO: 21485
  misc_feature 1..998: note = mRNA product Design a-1 (hSL-A100) comprising derived and/or modified sequence from HRSV(A2)__P03421.1__P (opt1)
  source 1..998: mol_type = other RNA

SEQ ID NO: 21487 - RNA, 857 nt, synthetic construct
  misc_feature 1..857: note = mRNA product Design a-1 (hSL-A100) comprising derived and/or modified sequence from HRSV(A2)__P04545.1__M2-1 (opt1)
  source 1..857: mol_type = other RNA
aggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21488 - RNA, 857 nt, synthetic construct; identical to SEQ ID NO: 21487
  misc_feature 1..857: note = mRNA product Design a-1 (hSL-A100) comprising derived and/or modified sequence from HRSV(A2)__P04545.1__M2-1 (opt1)
  source 1..857: mol_type = other RNA

SEQ ID NO: 21489 - RNA, 1997 nt, synthetic construct
  misc_feature 1..1997: note = mRNA product Design a-1 (hSL-A100) comprising derived and/or modified sequence from HRSV(Memphis-37)__AIY60640.1__F0 (opt1)
  source 1..1997: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21490 - RNA, 1997 nt, synthetic construct
  misc_feature 1..1997: note = mRNA product Design a-1 (hSL-A100) comprising derived and/or modified sequence from HRSV(Memphis-37)__AIY60640.1__F0 (opt1)
  source 1..1997: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctgctccacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21491 - RNA, 1934 nt, synthetic construct
  misc_feature 1..1934: note = mRNA product Design a-1 (hSL-A100) comprising derived and/or modified sequence from HRSV(Memphis-37)__AIY60640.1__F-del (opt1)
  source 1..1934: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21492 - RNA, 1934 nt, synthetic construct
  misc_feature 1..1934: note = mRNA product Design a-1 (hSL-A100) comprising derived and/or modified sequence from HRSV(Memphis-37)__AIY60640.1__F-del (opt1)
  source 1..1934: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctgctccacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21493 - RNA, 1997 nt, synthetic construct
  misc_feature 1..1997: note = mRNA product Design a-1 (hSL-A100) comprising derived and/or modified sequence from HRSV(Memphis-37)__AIY60640.1__F0_DSCav1 (opt1)
  source 1..1997: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21494 - RNA, 1997 nt, synthetic construct
  misc_feature 1..1997: note = mRNA product Design a-1 (hSL-A100) comprising derived and/or modified sequence from HRSV(Memphis-37)__AIY60640.1__F0_DSCav1 (opt1)
  source 1..1997: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21495 - RNA, 1997 nt, synthetic construct
  misc_feature 1..1997: note = mRNA product Design a-1 (hSL-A100) comprising derived and/or modified sequence from HRSV(Memphis-37)__AIY60640.1__F0_DSCav1 (opt1)
  source 1..1997: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctggccttcatccggaagtccgacgagctcctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21496 - RNA, 1934 nt, synthetic construct
  misc_feature 1..1934: note = mRNA product Design a-1 (hSL-A100) comprising derived and/or modified sequence from HRSV(Memphis-37)__AIY60640.1__F-del_DSCav1 (opt1)
  source 1..1934: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21497 - RNA, 1934 nt, synthetic construct
  misc_feature 1..1934: note = mRNA product Design a-1 (hSL-A100) comprising derived and/or modified sequence from HRSV(Memphis-37)__AIY60640.1__F-del_DSCav1 (opt1)
  source 1..1934: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21498 - RNA, 1934 nt, synthetic construct
  misc_feature 1..1934: note = mRNA product Design a-1 (hSL-A100) comprising derived and/or modified sequence from HRSV(Memphis-37)__AIY60640.1__F-del_DSCav1 (opt1)
  source 1..1934: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctggccttcatccggaagtccgacgagctcctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21499 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut0 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21500 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut0 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21501 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut0 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21502 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut0 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21503 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut0 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21504 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut0 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21505 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut1 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21506 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut1 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21507 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut1 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21508 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut1 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21509 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut1 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21510 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut1 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21511 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut2 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21512 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut2 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21513 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut2 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21514 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut2 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21515 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut2 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21516 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut2 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21517 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut3 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21518 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut3 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21519 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut3 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21520 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut3 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21521 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut3 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21522 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut3 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21523 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut4 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21524 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut4 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21525 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut4 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactgcgtgaacaagcaggagggcaagtccctctacgtgaagggggagcccatcatcaacttctacgaccccctggtcttcccgagcgacgagttcgacgcctccatcagccaggtgaacgagaagatcaaccagtccctggcgttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21526 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut4 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21527 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut4 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21528 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut4 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactgcgtgaacaagcaggagggcaagtccctctacgtgaagggggagcccatcatcaacttctacgaccccctggtcttcccgagcgacgagttcgacgcctccatcagccaggtgaacgagaagatcaaccagtccctggcgttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21529 - RNA, 1883 nt, synthetic construct
  misc_feature 1..1883: note = mRNA product Design a-1 (hSL-A100) comprising derived and/or modified sequence from HRSV(Memphis-37)__AIY60640.1__F_DSCav1_mut5 (opt1)
  source 1..1883: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21530 - RNA, 1883 nt, synthetic construct
  misc_feature 1..1883: note = mRNA product Design a-1 (hSL-A100) comprising derived and/or modified sequence from HRSV(Memphis-37)__AIY60640.1__F_DSCav1_mut5 (opt1)
  source 1..1883: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21531 - RNA, 1883 nt, synthetic construct
  misc_feature 1..1883: note = mRNA product Design a-1 (hSL-A100) comprising derived and/or modified sequence from HRSV(Memphis-37)__AIY60640.1__F_DSCav1_mut5 (opt1)
  source 1..1883: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggcagcaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccgcggcatcatcaagaccttctccaacgggtgcgactacgtcagcaacaagggcgtggacaccgtgagcgtcggcaacacgctgtactacgtgaacaagcaggaggggaagtccctctacgtgaagggcgagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21532 - RNA, 1820 nt, synthetic construct
  misc_feature 1..1820: note = mRNA product Design a-1 (hSL-A100) comprising derived and/or modified sequence from HRSV(Memphis-37)__AIY60640.1__F-del_DSCav1_mut5 (opt1)
  source 1..1820: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21533 - RNA, 1820 nt, synthetic construct
  misc_feature 1..1820: note = mRNA product Design a-1 (hSL-A100) comprising derived and/or modified sequence from HRSV(Memphis-37)__AIY60640.1__F-del_DSCav1_mut5 (opt1)
  source 1..1820: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21534 - RNA, 1820 nt, synthetic construct
  misc_feature 1..1820: note = mRNA product Design a-1 (hSL-A100) comprising derived and/or modified sequence from HRSV(Memphis-37)__AIY60640.1__F-del_DSCav1_mut5 (opt1)
  source 1..1820: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggcagcaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccgcggcatcatcaagaccttctccaacgggtgcgactacgtcagcaacaagggcgtggacaccgtgagcgtcggcaacacgctgtactacgtgaacaagcaggaggggaagtccctctacgtgaagggcgagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21535 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut6 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21536 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut6 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21537 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut6 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21538 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut6 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21539 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut6 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21540 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut6 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21541 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut7 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21542 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut7 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21543 - RNA, 1880 nt, synthetic construct
  misc_feature 1..1880: note = mRNA product Design a-1 (hSL-A100) comprising derived and/or modified sequence from HRSV(Memphis-37)__AIY60640.1__F_DSCav1_mut7 (opt1)
  source 1..1880: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21544 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut7 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21545 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut7 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21546 - RNA, 1817 nt, synthetic construct
  misc_feature 1..1817: note = mRNA product Design a-1 (hSL-A100) comprising derived and/or modified sequence from HRSV(Memphis-37)__AIY60640.1__F-del_DSCav1_mut7 (opt1)
  source 1..1817: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21547 - RNA, 1883 nt, synthetic construct
  misc_feature 1..1883: note = mRNA product Design a-1 (hSL-A100) comprising derived and/or modified sequence from HRSV(Memphis-37)__AIY60640.1__F_DSCav1_mut8 (opt1)
  source 1..1883: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21548 - RNA, 1883 nt, synthetic construct
  misc_feature 1..1883: note = mRNA product Design a-1 (hSL-A100) comprising derived and/or modified sequence from HRSV(Memphis-37)__AIY60640.1__F_DSCav1_mut8 (opt1)
  source 1..1883: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21549 - RNA, 1883 nt, synthetic construct
  misc_feature 1..1883: note = mRNA product Design a-1 (hSL-A100) comprising derived and/or modified sequence from HRSV(Memphis-37)__AIY60640.1__F_DSCav1_mut8 (opt1)
  source 1..1883: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21550 - RNA, 1820 nt, synthetic construct
  misc_feature 1..1820: note = mRNA product Design a-1 (hSL-A100) comprising derived and/or modified sequence from HRSV(Memphis-37)__AIY60640.1__F-del_DSCav1_mut8 (opt1)
  source 1..1820: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21551 - RNA, 1820 nt, synthetic construct
  misc_feature 1..1820: note = mRNA product Design a-1 (hSL-A100) comprising derived and/or modified sequence from HRSV(Memphis-37)__AIY60640.1__F-del_DSCav1_mut8 (opt1)
  source 1..1820: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21552 - RNA, 1820 nt, synthetic construct
  misc_feature 1..1820: note = mRNA product Design a-1 (hSL-A100) comprising derived and/or modified sequence from HRSV(Memphis-37)__AIY60640.1__F-del_DSCav1_mut8 (opt1)
  source 1..1820: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctgatcgccgtcggcctcttcctgtactgcaaggcccggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21553 - RNA, 1043 nt, synthetic construct; identical to SEQ ID NO: 21481
  misc_feature 1..1043: note = mRNA product Design a-1 (hSL-A100) comprising derived and/or modified sequence from HRSV(Memphis-37)__AIY60638.1__M (opt1)
  source 1..1043: mol_type = other RNA

SEQ ID NO: 21554 - RNA, 1043 nt, synthetic construct; identical to SEQ ID NO: 21481
  misc_feature 1..1043: note = mRNA product Design a-1 (hSL-A100) comprising derived and/or modified sequence from HRSV(Memphis-37)__AIY60638.1__M (opt1)
  source 1..1043: mol_type = other RNA

SEQ ID NO: 21555 - RNA, 1448 nt, synthetic construct
  misc_feature 1..1448: note = mRNA product Design a-1 (hSL-A100) comprising derived and/or modified sequence from HRSV(Memphis-37)__AIY60635.1__N (opt1)
  source 1..1448: mol_type = other RNA
aggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21556 - RNA, 1448 nt, synthetic construct; identical to SEQ ID NO: 21555
  misc_feature 1..1448: note = mRNA product Design a-1 (hSL-A100) comprising derived and/or modified sequence from HRSV(Memphis-37)__AIY60635.1__N (opt1)
  source 1..1448: mol_type = other RNA

SEQ ID NO: 21557 - RNA, 998 nt, synthetic construct
  misc_feature 1..998: note = mRNA product Design a-1 (hSL-A100) comprising derived and/or modified sequence from HRSV(Memphis-37)__AIY60637.1__P (opt1)
  source 1..998: mol_type = other RNA
aggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21558 - RNA, 998 nt, synthetic construct; identical to SEQ ID NO: 21557
  misc_feature 1..998: note = mRNA product Design a-1 (hSL-A100) comprising derived and/or modified sequence from HRSV(Memphis-37)__AIY60637.1__P (opt1)
  source 1..998: mol_type = other RNA

SEQ ID NO: 21559 - RNA, 857 nt, synthetic construct
  misc_feature 1..857: note = mRNA product Design a-1 (hSL-A100) comprising derived and/or modified sequence from HRSV(Memphis-37)__AIY60641.1__M2-1 (opt1)
  source 1..857: mol_type = other RNA
aggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21560 - RNA, 857 nt, synthetic construct; identical to SEQ ID NO: 21559
  misc_feature 1..857: note = mRNA product Design a-1 (hSL-A100) comprising derived and/or modified sequence from HRSV(Memphis-37)__AIY60641.1__M2-1 (opt1)
  source 1..857: mol_type = other RNA

SEQ ID NO: 21561 - RNA, 1973 nt, synthetic construct
  misc_feature 1..1973: note = mRNA product Design a-1 (A100) comprising derived and/or modified sequence from HRSV(A2)__F0 (opt1)
  source 1..1973: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21562 - RNA, 1973 nt, synthetic construct
  misc_feature 1..1973: note = mRNA product Design a-1 (A100) comprising derived and/or modified sequence from HRSV(A2)__F0 (opt1)
  source 1..1973: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21563 - RNA, 1973 nt, synthetic construct
  misc_feature 1..1973: note = mRNA product Design a-1 (A100) comprising derived and/or modified sequence from HRSV(A2)__F0 (opt1)
  source 1..1973: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctgctccacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21564 - RNA, 1910 nt, synthetic construct
  misc_feature 1..1910: note = mRNA product Design a-1 (A100) comprising derived and/or modified sequence from HRSV(A2)__F-del (opt1)
  source 1..1910: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21565 - RNA, 1910 nt, synthetic construct
  misc_feature 1..1910: note = mRNA product Design a-1 (A100) comprising derived and/or modified sequence from HRSV(A2)__F-del (opt1)
  source 1..1910: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21566 - RNA, 1910 nt, synthetic construct
  misc_feature 1..1910: note = mRNA product Design a-1 (A100) comprising derived and/or modified sequence from HRSV(A2)__F-del (opt1)
  source 1..1910: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctgctccacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21567 - RNA, 1973 nt, synthetic construct
  misc_feature 1..1973: note = mRNA product Design a-1 (A100) comprising derived and/or modified sequence from HRSV(A2)__F0_DSCav1 (opt1)
  source 1..1973: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21568 - RNA, 1973 nt, synthetic construct
  misc_feature 1..1973: note = mRNA product Design a-1 (A100) comprising derived and/or modified sequence from HRSV(A2)__F0_DSCav1 (opt1)
  source 1..1973: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21569 - RNA, 1973 nt, synthetic construct
  misc_feature 1..1973: note = mRNA product Design a-1 (A100) comprising derived and/or modified sequence from HRSV(A2)__F0_DSCav1 (opt1)
  source 1..1973: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctggccttcatccggaagtccgacgagctcctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21570 - RNA, 1910 nt, synthetic construct
  misc_feature 1..1910: note = mRNA product Design a-1 (A100) comprising derived and/or modified sequence from HRSV(A2)__F-del_DSCav1 (opt1)
  source 1..1910: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21571 - RNA, 1910 nt, synthetic construct
  misc_feature 1..1910: note = mRNA product Design a-1 (A100) comprising derived and/or modified sequence from HRSV(A2)__F-del_DSCav1 (opt1)
  source 1..1910: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21572 - RNA, 1910 nt, synthetic construct
  misc_feature 1..1910: note = mRNA product Design a-1 (A100) comprising derived and/or modified sequence from HRSV(A2)__F-del_DSCav1 (opt1)
  source 1..1910: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctggccttcatccggaagtccgacgagctcctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21573 - RNA, 1856 nt, synthetic construct
  misc_feature 1..1856: note = mRNA product Design a-1 (A100) comprising derived and/or modified sequence from HRSV(A2)__F_DSCav1_mut0 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21574 - RNA, 1856 nt, synthetic construct
  misc_feature 1..1856: note = mRNA product Design a-1 (A100) comprising derived and/or modified sequence from HRSV(A2)__F_DSCav1_mut0 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21575 - RNA, 1856 nt, synthetic construct
  misc_feature 1..1856: note = mRNA product Design a-1 (A100) comprising derived and/or modified sequence from HRSV(A2)__F_DSCav1_mut0 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21576 - RNA, 1793 nt, synthetic construct
  misc_feature 1..1793: note = mRNA product Design a-1 (A100) comprising derived and/or modified sequence from HRSV(A2)__F-del_DSCav1_mut0 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21577 - RNA, 1793 nt, synthetic construct
  misc_feature 1..1793: note = mRNA product Design a-1 (A100) comprising derived and/or modified sequence from HRSV(A2)__F-del_DSCav1_mut0 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactacgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21578 - RNA, 1793 nt, synthetic construct
  misc_feature 1..1793: note = mRNA product Design a-1 (A100) comprising derived and/or modified sequence from HRSV(A2)__F-del_DSCav1_mut0 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21579 - RNA, 1856 nt, synthetic construct
  misc_feature 1..1856: note = mRNA product Design a-1 (A100) comprising derived and/or modified sequence from HRSV(A2)__F_DSCav1_mut1 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21580 - RNA, 1856 nt, synthetic construct
  misc_feature 1..1856: note = mRNA product Design a-1 (A100) comprising derived and/or modified sequence from HRSV(A2)__F_DSCav1_mut1 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21581 - RNA, 1856 nt, synthetic construct
  misc_feature 1..1856: note = mRNA product Design a-1 (A100) comprising derived and/or modified sequence from HRSV(A2)__F_DSCav1_mut1 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21582 - RNA, 1793 nt, synthetic construct
  misc_feature 1..1793: note = mRNA product Design a-1 (A100) comprising derived and/or modified sequence from HRSV(A2)__F-del_DSCav1_mut1 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21583 - RNA, 1793 nt, synthetic construct
  misc_feature 1..1793: note = mRNA product Design a-1 (A100) comprising derived and/or modified sequence from HRSV(A2)__F-del_DSCav1_mut1 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21584 - RNA, 1793 nt, synthetic construct
  misc_feature 1..1793: note = mRNA product Design a-1 (A100) comprising derived and/or modified sequence from HRSV(A2)__F-del_DSCav1_mut1 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21585 - RNA, 1856 nt, synthetic construct
  misc_feature 1..1856: note = mRNA product Design a-1 (A100) comprising derived and/or modified sequence from HRSV(A2)__F_DSCav1_mut2 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21586 - RNA, 1856 nt, synthetic construct
  misc_feature 1..1856: note = mRNA product Design a-1 (A100) comprising derived and/or modified sequence from HRSV(A2)__F_DSCav1_mut2 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21587 - RNA, 1856 nt, synthetic construct
  misc_feature 1..1856: note = mRNA product Design a-1 (A100) comprising derived and/or modified sequence from HRSV(A2)__F_DSCav1_mut2 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21588 - RNA, 1793 nt, synthetic construct
  misc_feature 1..1793: note = mRNA product Design a-1 (A100) comprising derived and/or modified sequence from HRSV(A2)__F-del_DSCav1_mut2 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21589 - RNA, 1793 nt, synthetic construct
  misc_feature 1..1793: note = mRNA product Design a-1 (A100) comprising derived and/or modified sequence from HRSV(A2)__F-del_DSCav1_mut2 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21590 - RNA, 1793 nt, synthetic construct
  misc_feature 1..1793: note = mRNA product Design a-1 (A100) comprising derived and/or modified sequence from HRSV(A2)__F-del_DSCav1_mut2 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21591 - RNA, 1856 nt, synthetic construct
  misc_feature 1..1856: note = mRNA product Design a-1 (A100) comprising derived and/or modified sequence from HRSV(A2)__F_DSCav1_mut3 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21592 - RNA, 1856 nt, synthetic construct
  misc_feature 1..1856: note = mRNA product Design a-1 (A100) comprising derived and/or modified sequence from HRSV(A2)__F_DSCav1_mut3 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21593 - RNA, 1856 nt, synthetic construct
  misc_feature 1..1856: note = mRNA product Design a-1 (A100) comprising derived and/or modified sequence from HRSV(A2)__F_DSCav1_mut3 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21594 - RNA, 1793 nt, synthetic construct
  misc_feature 1..1793: note = mRNA product Design a-1 (A100) comprising derived and/or modified sequence from HRSV(A2)__F-del_DSCav1_mut3 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21595 - RNA, 1793 nt, synthetic construct
  misc_feature 1..1793: note = mRNA product Design a-1 (A100) comprising derived and/or modified sequence from HRSV(A2)__F-del_DSCav1_mut3 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21596 - RNA, 1793 nt, synthetic construct
  misc_feature 1..1793: note = mRNA product Design a-1 (A100) comprising derived and/or modified sequence from HRSV(A2)__F-del_DSCav1_mut3 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21597 - RNA, 1856 nt, synthetic construct
  misc_feature 1..1856: note = mRNA product Design a-1 (A100) comprising derived and/or modified sequence from HRSV(A2)__F_DSCav1_mut4 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21598 - RNA, 1856 nt, synthetic construct
  misc_feature 1..1856: note = mRNA product Design a-1 (A100) comprising derived and/or modified sequence from HRSV(A2)__F_DSCav1_mut4 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtccaccccggtgaccctgagcaaggaccagctctccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21599 - RNA, 1856 nt, synthetic construct
  misc_feature 1..1856: note = mRNA product Design a-1 (A100) comprising derived and/or modified sequence from HRSV(A2)__F_DSCav1_mut4 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgccggctccgtgagcttcttcccccaggcggagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactgcgtcaacaagcaggaggggaagtccctctacgtgaagggcgagcccatcatcaacttctacgaccccctggtgttccccagcgacgagttcgacgcctccatcagccaggtcaacgagaagatcaaccagtccctggccttcatccggaagtccgacgagctcctgcacaacgtgaacgcggggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21600 - RNA, 1793 nt, synthetic construct
  misc_feature 1..1793: note = mRNA product Design a-1 (A100) comprising derived and/or modified sequence from HRSV(A2)__F-del_DSCav1_mut4 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21601 - RNA, 1793 nt, synthetic construct
  misc_feature 1..1793: note = mRNA product Design a-1 (A100) comprising derived and/or modified sequence from HRSV(A2)__F-del_DSCav1_mut4 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21602 - RNA, 1793 nt, synthetic construct
  misc_feature 1..1793: note = mRNA product Design a-1 (A100) comprising derived and/or modified sequence from HRSV(A2)__F-del_DSCav1_mut4 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggcagcaacatctgcctgacccgcaccgaccgggggtggtactgcgacaacgccggctccgtgagcttcttcccccaggcggagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccgcggcatcatcaagaccttctccaacgggtgcgactacgtgagcaacaagggcgtcgacacggtgagcgtgggcaacaccctgtactgcgtcaacaagcaggaggggaagtccctctacgtgaagggcgagcccatcatcaacttctacgaccccctggtgttccccagcgacgagttcgacgcctccatcagccaggtcaacgagaagatcaaccagtccctggccttcatccggaagtccgacgagctcctgcacaacgtgaacgcggggaagtccaccaccaacatcatgatcaccacgatcatcatcgtgatcatcgtcatcctgctcagcctgatcgccgtgggcctgctgctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21603 - RNA, 1859 nt, synthetic construct
  misc_feature 1..1859: note = mRNA product Design a-1 (A100) comprising derived and/or modified sequence from HRSV(A2)__F_DSCav1_mut5 (opt1)
  source 1..1859: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21604 - RNA, 1859 nt, synthetic construct
  misc_feature 1..1859: note = mRNA product Design a-1 (A100) comprising derived and/or modified sequence from HRSV(A2)__F_DSCav1_mut5 (opt1)
  source 1..1859: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21605 - RNA, 1859 nt, synthetic construct
  misc_feature 1..1859: note = mRNA product Design a-1 (A100) comprising derived and/or modified sequence from HRSV(A2)__F_DSCav1_mut5 (opt1)
  source 1..1859: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggagcaacatctgcctgacccgcaccgaccggggctggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgcgggatcatcaagaccttctccaacggctgcgactacgtgagcaacaagggcgtcgacacggtgagcgtggggaacaccctgtactacgtcaacaagcaggagggcaagtccctctacgtgaagggggagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctccaccccggtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21606 - RNA, 1796 nt, synthetic construct
  misc_feature 1..1796: note = mRNA product Design a-1 (A100) comprising derived and/or modified sequence from HRSV(A2)__F-del_DSCav1_mut5 (opt1)
  source 1..1796: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21607 - RNA, 1796 nt, synthetic construct
  misc_feature 1..1796: note = mRNA product Design a-1 (A100) comprising derived and/or modified sequence from HRSV(A2)__F-del_DSCav1_mut5 (opt1)
  source 1..1796: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21608 - RNA, 1796 nt, synthetic construct
  misc_feature 1..1796: note = mRNA product Design a-1 (A100) comprising derived and/or modified sequence from HRSV(A2)__F-del_DSCav1_mut5 (opt1)
  source 1..1796: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggagcaacatctgcctgacccgcaccgaccggggctggtactgcgacaacgcgggctccgtgagcttcttcccccaggccgagacctgcaaggtccagtccaaccgcgtgttctgcgacacgatgaacagccggaccctgccctccgaggtcaacctctgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgcgggatcatcaagaccttctccaacggctgcgactacgtgagcaacaagggcgtcgacacggtgagcgtggggaacaccctgtactacgtcaacaagcaggagggcaagtccctctacgtgaagggggagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21609 - RNA, 1856 nt, synthetic construct
  misc_feature 1..1856: note = mRNA product Design a-1 (A100) comprising derived and/or modified sequence from HRSV(A2)__F_DSCav1_mut6 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21610 - RNA, 1856 nt, synthetic construct
  misc_feature 1..1856: note = mRNA product Design a-1 (A100) comprising derived and/or modified sequence from HRSV(A2)__F_DSCav1_mut6 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21611 - RNA, 1856 nt, synthetic construct
  misc_feature 1..1856: note = mRNA product Design a-1 (A100) comprising derived and/or modified sequence from HRSV(A2)__F_DSCav1_mut6 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21612 - RNA, 1793 nt, synthetic construct
  misc_feature 1..1793: note = mRNA product Design a-1 (A100) comprising derived and/or modified sequence from HRSV(A2)__F-del_DSCav1_mut6 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21613 - RNA, 1793 nt, synthetic construct
  misc_feature 1..1793: note = mRNA product Design a-1 (A100) comprising derived and/or modified sequence from HRSV(A2)__F-del_DSCav1_mut6 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21614 - RNA, 1793 nt, synthetic construct
  misc_feature 1..1793: note = mRNA product Design a-1 (A100) comprising derived and/or modified sequence from HRSV(A2)__F-del_DSCav1_mut6 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctgctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21615 - RNA, 1856 nt, synthetic construct
  misc_feature 1..1856: note = mRNA product Design a-1 (A100) comprising derived and/or modified sequence from HRSV(A2)__F_DSCav1_mut7 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21616 - RNA, 1856 nt, synthetic construct
  misc_feature 1..1856: note = mRNA product Design a-1 (A100) comprising derived and/or modified sequence from HRSV(A2)__F_DSCav1_mut7 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21617 - RNA, 1856 nt, synthetic construct
  misc_feature 1..1856: note = mRNA product Design a-1 (A100) comprising derived and/or modified sequence from HRSV(A2)__F_DSCav1_mut7 (opt1)
  source 1..1856: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21618 - RNA, 1793 nt, synthetic construct
  misc_feature 1..1793: note = mRNA product Design a-1 (A100) comprising derived and/or modified sequence from HRSV(A2)__F-del_DSCav1_mut7 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21619 - RNA, 1793 nt, synthetic construct
  misc_feature 1..1793: note = mRNA product Design a-1 (A100) comprising derived and/or modified sequence from HRSV(A2)__F-del_DSCav1_mut7 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21620 - RNA, 1793 nt, synthetic construct
  misc_feature 1..1793: note = mRNA product Design a-1 (A100) comprising derived and/or modified sequence from HRSV(A2)__F-del_DSCav1_mut7 (opt1)
  source 1..1793: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctgctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21621 - RNA, 1859 nt, synthetic construct
  misc_feature 1..1859: note = mRNA product Design a-1 (A100) comprising derived and/or modified sequence from HRSV(A2)__F_DSCav1_mut8 (opt1)
  source 1..1859: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21622 - RNA, 1859 nt, synthetic construct
  misc_feature 1..1859: note = mRNA product Design a-1 (A100) comprising derived and/or modified sequence from HRSV(A2)__F_DSCav1_mut8 (opt1)
  source 1..1859: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21623 - RNA, 1859 nt, synthetic construct
  misc_feature 1..1859: note = mRNA product Design a-1 (A100) comprising derived and/or modified sequence from HRSV(A2)__F_DSCav1_mut8 (opt1)
  source 1..1859: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctgctcctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21624 - RNA, 1796 nt, synthetic construct
  misc_feature 1..1796: note = mRNA product Design a-1 (A100) comprising derived and/or modified sequence from HRSV(A2)__F-del_DSCav1_mut8 (opt1)
  source 1..1796: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21625 - RNA, 1796 nt, synthetic construct
  misc_feature 1..1796: note = mRNA product Design a-1 (A100) comprising derived and/or modified sequence from HRSV(A2)__F-del_DSCav1_mut8 (opt1)
  source 1..1796: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21626 - RNA, 1796 nt, synthetic construct
  misc_feature 1..1796: note = mRNA product Design a-1 (A100) comprising derived and/or modified sequence from HRSV(A2)__F-del_DSCav1_mut8 (opt1)
  source 1..1796: mol_type = other RNA
aggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21627 - RNA, 1019 nt, synthetic construct
  misc_feature 1..1019: note = mRNA product Design a-1 (A100) comprising derived and/or modified sequence from HRSV(A2)__P0DOE7.1__M (opt1)
  source 1..1019: mol_type = other RNA
aggagagtcccgcagtcggcgtccagcggctctgcttgttcgtgtgtgtgtcgttgcaggccttattcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21628 - RNA, 1019 nt, synthetic construct; identical to SEQ ID NO: 21627
  misc_feature 1..1019: note = mRNA product Design a-1 (A100) comprising derived and/or modified sequence from HRSV(A2)__P0DOE7.1__M (opt1)
  source 1..1019: mol_type = other RNA

SEQ ID NO: 21629 - RNA, 1424 nt, synthetic construct
  misc_feature 1..1424: note = mRNA product Design a-1 (A100) comprising derived and/or modified sequence from HRSV(A2)__P03418.1__N (opt1)
  source 1..1424: mol_type = other RNA
aggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21630 - RNA, 1424 nt, synthetic construct; identical to SEQ ID NO: 21629
  misc_feature 1..1424: note = mRNA product Design a-1 (A100) comprising derived and/or modified sequence from HRSV(A2)__P03418.1__N (opt1)
  source 1..1424: mol_type = other RNA

SEQ ID NO: 21631 - RNA, 974 nt, synthetic construct
  misc_feature 1..974: note = mRNA product Design a-1 (A100) comprising derived and/or modified sequence from HRSV(A2)__P03421.1__P (opt1)
  source 1..974: mol_type = other RNA
aggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatgatcggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21632 - RNA, 974 nt, synthetic construct; identical to SEQ ID NO: 21631
  misc_feature 1..974: note = mRNA product Design a-1 (A100) comprising derived and/or modified sequence from HRSV(A2)__P03421.1__P (opt1)
  source 1..974: mol_type = other RNA

SEQ ID NO: 21633 - RNA, 833 nt, synthetic construct
  misc_feature 1..833: note = mRNA product Design a-1 (A100) comprising derived and/or modified sequence from HRSV(A2)__P04545.1__M2-1 (opt1)
  source 1..833: mol_type = other RNA
aggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagctcaactcccccaagatccgcgtgtacaacaccgtgatcagctacatcgagtccaaccggaagaacaacaagcagaccatccacctcctgaagcgcctgcccgccgacgtcctgaagaagacgatcaagaacaccctggacatccacaagagcatcaccatcaacaacccgaaggagtccaccgtgagcgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21634 - RNA, 833 nt, synthetic construct; identical to SEQ ID NO: 21633
  misc_feature 1..833: note = mRNA product Design a-1 (A100) comprising derived and/or modified sequence from HRSV(A2)__P04545.1__M2-1 (opt1)
  source 1..833: mol_type = other RNA

SEQ ID NO: 21635 - RNA, 1973 nt, synthetic construct
  misc_feature 1..1973: note = mRNA product Design a-1 (A100) comprising derived and/or modified sequence from HRSV(Memphis-37)__AIY60640.1__F0 (opt1)
  source 1..1973: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21636 - RNA, 1973 nt, synthetic construct
  misc_feature 1..1973: note = mRNA product Design a-1 (A100) comprising derived and/or modified sequence from HRSV(Memphis-37)__AIY60640.1__F0 (opt1)
  source 1..1973: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctgctccacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21637 - RNA, 1910 nt, synthetic construct
  misc_feature 1..1910: note = mRNA product Design a-1 (A100) comprising derived and/or modified sequence from HRSV(Memphis-37)__AIY60640.1__F-del (opt1)
  source 1..1910: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21638 - RNA, 1910 nt, synthetic construct
  misc_feature 1..1910: note = mRNA product Design a-1 (A100) comprising derived and/or modified sequence from HRSV(Memphis-37)__AIY60640.1__F-del (opt1)
  source 1..1910: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctgctccacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21639 - RNA, 1973 nt, synthetic construct
  misc_feature 1..1973: note = mRNA product Design a-1 (A100) comprising derived and/or modified sequence from HRSV(Memphis-37)__AIY60640.1__F0_DSCav1 (opt1)
  source 1..1973: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21640 - RNA, 1973 nt, synthetic construct
  misc_feature 1..1973: note = mRNA product Design a-1 (A100) comprising derived and/or modified sequence from HRSV(Memphis-37)__AIY60640.1__F0_DSCav1 (opt1)
  source 1..1973: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21641 - RNA, 1973 nt, synthetic construct
  misc_feature 1..1973: note = mRNA product Design a-1 (A100) comprising derived and/or modified sequence from HRSV(Memphis-37)__AIY60640.1__F0_DSCav1 (opt1)
  source 1..1973: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctggccttcatccggaagtccgacgagctcctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21642 - RNA, 1910 nt, synthetic construct
  misc_feature 1..1910: note = mRNA product Design a-1 (A100) comprising derived and/or modified sequence from HRSV(Memphis-37)__AIY60640.1__F-del_DSCav1 (opt1)
  source 1..1910: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21643 - RNA, 1910 nt, synthetic construct
  misc_feature 1..1910: note = mRNA product Design a-1 (A100) comprising derived and/or modified sequence from HRSV(Memphis-37)__AIY60640.1__F-del_DSCav1 (opt1)
  source 1..1910: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21644 - RNA, 1910 nt, synthetic construct
  misc_feature 1..1910: note = mRNA product Design a-1 (A100) comprising derived and/or modified sequence from HRSV(Memphis-37)__AIY60640.1__F-del_DSCav1 (opt1)
  source 1..1910: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctggccttcatccggaagtccgacgagctcctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21645 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut0 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21646 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut0 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21647 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut0 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21648 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut0 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21649 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut0 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21650 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut0 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21651 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut1 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21652 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut1 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21653 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut1 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21654 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut1 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21655 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut1 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21656 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut1 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21657 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut2 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21658 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut2 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21659 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut2 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21660 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut2 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21661 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut2 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21662 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut2 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21663 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut3 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21664 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut3 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21665 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut3 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21666 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut3 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21667 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut3 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21668 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut3 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21669 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut4 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21670 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut4 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21671 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut4 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactgcgtgaacaagcaggagggcaagtccctctacgtgaagggggagcccatcatcaacttctacgaccccctggtcttcccgagcgacgagttcgacgcctccatcagccaggtgaacgagaagatcaaccagtccctggcgttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21672 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut4 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21673 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut4 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21674 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut4 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgcgggatcatcaagaccttctccaacggctgcgactacgtcagcaacaagggggtggacaccgtgagcgtcggcaacacgctgtactgcgtgaacaagcaggagggcaagtccctctacgtgaagggggagcccatcatcaacttctacgaccccctggtcttcccgagcgacgagttcgacgcctccatcagccaggtgaacgagaagatcaaccagtccctggcgttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21675 - RNA, 1859 nt, synthetic construct
  misc_feature 1..1859: note = mRNA product Design a-1 (A100) comprising derived and/or modified sequence from HRSV(Memphis-37)__AIY60640.1__F_DSCav1_mut5 (opt1)
  source 1..1859: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21676 - RNA, 1859 nt, synthetic construct
  misc_feature 1..1859: note = mRNA product Design a-1 (A100) comprising derived and/or modified sequence from HRSV(Memphis-37)__AIY60640.1__F_DSCav1_mut5 (opt1)
  source 1..1859: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21677 - RNA, 1859 nt, synthetic construct
  misc_feature 1..1859: note = mRNA product Design a-1 (A100) comprising derived and/or modified sequence from HRSV(Memphis-37)__AIY60640.1__F_DSCav1_mut5 (opt1)
  source 1..1859: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggcagcaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccgcggcatcatcaagaccttctccaacgggtgcgactacgtcagcaacaagggcgtggacaccgtgagcgtcggcaacacgctgtactacgtgaacaagcaggaggggaagtccctctacgtgaagggcgagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21678 - RNA, 1796 nt, synthetic construct
  misc_feature 1..1796: note = mRNA product Design a-1 (A100) comprising derived and/or modified sequence from HRSV(Memphis-37)__AIY60640.1__F-del_DSCav1_mut5 (opt1)
  source 1..1796: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21679 - RNA, 1796 nt, synthetic construct
  misc_feature 1..1796: note = mRNA product Design a-1 (A100) comprising derived and/or modified sequence from HRSV(Memphis-37)__AIY60640.1__F-del_DSCav1_mut5 (opt1)
  source 1..1796: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggctccaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccggggcatcatcaagaccttctccaacgggtgcgactacgtcagcaacaagggcgtggacaccgtgagcgtcggcaacacgctctactacgtgaacaagcaggaggggaagtccctgtacgtgaagggcgagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21680 - RNA, 1796 nt, synthetic construct
  misc_feature 1..1796: note = mRNA product Design a-1 (A100) comprising derived and/or modified sequence from HRSV(Memphis-37)__AIY60640.1__F-del_DSCav1_mut5 (opt1)
  source 1..1796: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcggctgcggggtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggcgtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggggtcatcgacaccccctgctggaagctgcacacgagccccctctgcaccaccaacaccaaggagggcagcaacatctgcctgacgcgcaccgaccgggggtggtactgcgacaacgccggctccgtgagcttcttcccccaggccgagacctgcaaggtgcagtccaaccgcgtcttctgcgacaccatgaacagccggacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagtgccgcggcatcatcaagaccttctccaacgggtgcgactacgtcagcaacaagggcgtggacaccgtgagcgtcggcaacacgctgtactacgtgaacaagcaggaggggaagtccctctacgtgaagggcgagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21681 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut6 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21682 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut6 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21683 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut6 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccggagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21684 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut6 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21685 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut6 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21686 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut6 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctgttcctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21687 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut7 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21688 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut7 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21689 - RNA, 1856 nt, synthetic construct
  misc_feature 1..1856: note = mRNA product Design a-1 (A100) comprising derived and/or modified sequence from HRSV(Memphis-37)__AIY60640.1__F_DSCav1_mut7 (opt1)
  source 1..1856: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21690 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut7 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21691 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut7 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21692 - RNA, 1793 nt, synthetic construct
  misc_feature 1..1793: note = mRNA product Design a-1 (A100) comprising derived and/or modified sequence from HRSV(Memphis-37)__AIY60640.1__F-del_DSCav1_mut7 (opt1)
  source 1..1793: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21693 - RNA, 1859 nt, synthetic construct
  misc_feature 1..1859: note = mRNA product Design a-1 (A100) comprising derived and/or modified sequence from HRSV(Memphis-37)__AIY60640.1__F_DSCav1_mut8 (opt1)
  source 1..1859: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21694 - RNA, 1859 nt, synthetic construct
  misc_feature 1..1859: note = mRNA product Design a-1 (A100) comprising derived and/or modified sequence from HRSV(Memphis-37)__AIY60640.1__F_DSCav1_mut8 (opt1)
  source 1..1859: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21695 - RNA, 1859 nt, synthetic construct
  misc_feature 1..1859: note = mRNA product Design a-1 (A100) comprising derived and/or modified sequence from HRSV(Memphis-37)__AIY60640.1__F_DSCav1_mut8 (opt1)
  source 1..1859: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctgatcgccgtcggcctcttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21696 - RNA, 1796 nt, synthetic construct
  misc_feature 1..1796: note = mRNA product Design a-1 (A100) comprising derived and/or modified sequence from HRSV(Memphis-37)__AIY60640.1__F-del_DSCav1_mut8 (opt1)
  source 1..1796: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21697 - RNA, 1796 nt, synthetic construct
  misc_feature 1..1796: note = mRNA product Design a-1 (A100) comprising derived and/or modified sequence from HRSV(Memphis-37)__AIY60640.1__F-del_DSCav1_mut8 (opt1)
  source 1..1796: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21698 - RNA, 1796 nt, synthetic construct
  misc_feature 1..1796: note = mRNA product Design a-1 (A100) comprising derived and/or modified sequence from HRSV(Memphis-37)__AIY60640.1__F-del_DSCav1_mut8 (opt1)
  source 1..1796: mol_type = other RNA
aggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21699 - RNA, 1019 nt, synthetic construct; identical to SEQ ID NO: 21627
  misc_feature 1..1019: note = mRNA product Design a-1 (A100) comprising derived and/or modified sequence from HRSV(Memphis-37)__AIY60638.1__M (opt1)
  source 1..1019: mol_type = other RNA

SEQ ID NO: 21700 - RNA, 1019 nt, synthetic construct; identical to SEQ ID NO: 21627
  misc_feature 1..1019: note = mRNA product Design a-1 (A100) comprising derived and/or modified sequence from HRSV(Memphis-37)__AIY60638.1__M (opt1)
  source 1..1019: mol_type = other RNA

SEQ ID NO: 21701 - RNA, 1424 nt, synthetic construct
  misc_feature 1..1424: note = mRNA product Design a-1 (A100) comprising derived and/or modified sequence from HRSV(Memphis-37)__AIY60635.1__N (opt1)
  source 1..1424: mol_type = other RNA
aggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21702 - RNA, 1424 nt, synthetic construct; identical to SEQ ID NO: 21701
  misc_feature 1..1424: note = mRNA product Design a-1 (A100) comprising derived and/or modified sequence from HRSV(Memphis-37)__AIY60635.1__N (opt1)
  source 1..1424: mol_type = other RNA

SEQ ID NO: 21703 - RNA, 974 nt, synthetic construct
  misc_feature 1..974: note = mRNA product Design a-1 (A100) comprising derived and/or modified sequence from HRSV(Memphis-37)__AIY60637.1__P (opt1)
  source 1..974: mol_type = other RNA
aggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21704 - RNA, 974 nt, synthetic construct; identical to SEQ ID NO: 21703
  misc_feature 1..974: note = mRNA product Design a-1 (A100) comprising derived and/or modified sequence from HRSV(Memphis-37)__AIY60637.1__P (opt1)
  source 1..974: mol_type = other RNA

SEQ ID NO: 21705 - RNA, 833 nt, synthetic construct
  misc_feature 1..833: note = mRNA product Design a-1 (A100) comprising derived and/or modified sequence from HRSV(Memphis-37)__AIY60641.1__M2-1 (opt1)
  source 1..833: mol_type = other RNA
aggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 21706 - RNA, 833 nt, synthetic construct; identical to SEQ ID NO: 21705
  misc_feature 1..833: note = mRNA product Design a-1 (A100) comprising derived and/or modified sequence from HRSV(Memphis-37)__AIY60641.1__M2-1 (opt1)
  source 1..833: mol_type = other RNA
